United States Patent 11,602,550 (COMPOSITIONS COMPRISING BACTERIAL STRAINS AND USE THEREOF IN CONTROLLING PATHOGENIC MICROORGANISMS) - sequence listing, part 2

SEQ ID NO: 4 - DNA, 3928316 bp, Bacillus amyloliquefaciens (residues 1,964,159-3,928,316 of 3,928,316)
tggacgccgccggcaattgagccgttgtatccgccggcaatcatccgcttatctctgactacggttgccccgactgacagtctcggacatgtgcttctcagcgccagcaaatggctttgcgccataaaatattgattccatgagattcgttccacaagtgttccctccaaaaagtcttgttgcttttctaagtttacatagatttaagcagaaccgtcaattcactttaccgtaatggaagtttttatccgctcaaatgacttttctccaaagcctgatacattcatcaaatcttcagcagtctgaaaccgtccgttttcttctcggtaggcgataatggcttccgcttttttctgccccaccccggaaatcgcctgaagttcgtccaaagatgccgtattgatattgacagctgcattctccttttcacccgctgctgttttcgggtgattctcttcttcgccttcactcggaatataaacaatcgtcccgtcctgcagctgctctgctaaattaacattcaattcatccgcctttttcttcaggcctccggctttttcaatggcttgcgtcactctgtctcccgctttcatttcatacacgccgggatttcggaccgcacctttcacatcaatcataatcttatcgtctgcggtgtcttttttgtccgcgacggatgccgaggctgtttggccgagcacggactgctgtttgaccggctcttccttttcagaacgaaacagccaaatacagataaaaaccgcccctgccgcaagacaagcgcccagaattttcaggttccgccgcagccgctccgtcatcatcgctttcgtcatattgcattgcctccccgcataaggtttagaggattaagggaaaaaggaggggaattcattgaaaataggctttatcggcaccggaaacatgggaacgatcctgattgaatcgtttatcgaatcaaacgctgccgatccctcacatatcaccatcacaaacagaacaatcgaaaaagcattaaaactaaaagaacgtttcagcggcatccatgtcactgaggatcaggaaaagctcgtacaggataatgaaataatattcatttgtgtaaaaccgctggatatatatcctttgctgaaaaaactcacaccgcatttacggaaagatcacattttaatctccattaccagccccgttcagacggatcagattgaacatacggttccgtgtcagacggcccgcgtcattccgagcattacgaaccgcgccttggccggcgtctcgcttgttacgttcggcaaaagctgcagcgagtctgcaaaagcggatattcaaacgctgttcactcatatttcaaaacctgttgaaatcagcagcggcattacaagagcggcgtcagacattgtcagctgcggacccgcttttatgagttatctcgttcagcgctttattgacgcggcagtggaagaaacggacatcaccaaagaagaagccgtgattatgtcgacagaaatgcttgtcggtctcggaaagcttcttgaaacggggcattacacgcttcccgccttgcaggaaaaagtatgcgtaaaaggcggcgtcaccggagaaggactgaaggctctcgaaagcggtgttcaggatatgttcaatcgtgtctttcagcgtacacatgacaaatacgatgaagatatatcgttagtgaagaagcaatttcacgtgtaactgagtatgccataaagagctttatcgcgccaatcgcaaaaaatgcattttaaaaaccatcgttccgtttaaacgatggtttttggtttgcctgccgtaaagaaaagacgttcagactctgttgaaggaggccggtctgtaaaatcagccgtcaccttcttcagttcaaatccggtctctgcaagcatttgttcatattcttcaatgtaaaatgttttttgctcatgcgtctcgtcatagcggtcataagattgtccgttccatacgaaaaaggacatatcatggatgacagaaagctcttcatcgccggcaaagctttgccagatatagctgatctgctcatcctgatccgcatgggtgctgtccggaaaaagctccgtcattttatacggggaatggacgtcaaacagaagcaggccgccctccttcaaaacttgaaaaacacttttgaaggtgcttaagacatcatttttcgtttttaagtaatttagggaatcacagcagatgactacggcatcaaactgttcttcaaaaccggaaagctctctcatatcctgctggagaaaaagaatcggctttcccgtttttttctgctgggcacagctcagcatatcttcactcaaatcaatccccgtgacttcgcagcctttttcagcaagcctgatggatatttctccggttccgcaggcaagatcaagcacccttcccttttccggaagagacgcttcaatccagcccgcccattcatcatacggcgcatgtgacattaactcgtcatatacaccggcgaagccttggtaaatcatgagttcaagccgagttcaagctctgcgagcggcgcgtcgccccatagcttttcaagattatagtagcttctttcatctttatggaaaacgtggacaatgacgtcgccgagatcaactaaaacccagcgggcctcatcaaacccttccatctttttgacatcaatgccgttttcttctgcctgatctttaatttcacgcgcaatggcctgaacctgtttatcagaattcccgtggcagattaaaaagtaatccgctacaagtgagattccttccatgtccagcgctaaaatatcttctgcacgtttatcgtcgcatgcttttgccgcgatttttaatacggaagcttgattcattttccatattcctcctgtcatttttgagacaccagccagttataggttgcaaacgtctccggaaagaccggctggttttttttcatcagaaatatcattgtatttttcatcgcttgtatgagcgcttcgttcagatctgtttccgccagacggcgcacctcttccactccgggaaaatggcggccgggttcaatgtaatccgcaacgtagatgactttgtctaaaagggtcattccgggacgccctgacgtgtgatagcggattgcatccaagacctcgggatcagtgatccccgcttctttctcagccaaatacgctcccacaggggcatgccacagctcggcattgtaatccaagagctcagcaggcattttttcccgcacgatgatctgcttcatttcttctttcggccggaatttcgcataatcatgaaaaatagccgccatttccgcttttttcggatctgctccgaaccggcctgcgagaataaccgccgtatctgtcacgccgattgtgtggatgtagcgatgctcggtcagctgttctttgacgcaggcaagtgcttcctcacgattcatataaatcattctcctctatatactgcctcactttatccggcattaagtattgcgtcggcttttttgctttgagacgttctctcagcatcgttgacgaaacgtcaaattccggaacgtcggcaaaaagcagcgggtacggggtctcgatatgataccccgggcgccgcactccgataaattgaatgagcgtgagcagttcgtccaatttgtaccatttcggcagatattcaatcatatccgccccgataataaagaaaagcttgtcgttcgggtgccgctccttcagtaaacggacggtatcataggtataagaagggcctttccggtccatttccgcaagctcaagcttaaagaaggaattagagctgatggcaagcttcagcatctccacccggtgccggctgtctgtaaagtcttcattctgcttatgcggcgggattttattgggcataaaccaaatctcatcgagctccgcctgatgaaggacttcattagccatcagaagatgtccgttgtgcggagggtcaaatgtgcccccgaatattccgattttcttcatgtcaaccaccttacggaagctcgatttgtttattttcctttgattccttatacaatacgatcgtatttccgatcgtctgcaccaattgtgagcggctgcctttcacaagggcttctgcgacatcgtttttatcgtcttcgcagttttgaagcacgctgactttaatcagctctcttgcttctaaagcctcggcaatctgtttcaccatgttttcgttgactccgccttttcccacttgaaaaataggcgttaaatgatgcgcttttgaacgcaaaaaccgtttttgttttcctgttaacattgtgttcctcctagttttccttcaacaattgctctcattaagccgctgtcaggctcttgttccgtccacagcttgaaagacagtgcagcctgttccacaaacatgccgacaccgtcaagggttgttaaacctcttttttcagcttcttttaagaacgccgtttgaatcgggttgtatacgatatcacaaacgatggcgcccgttttggcccgttccaatgagagcggcacggcatccgttttcggatacatgccgacagatgttgtatgaataatgacgtcatattgttcaagctgattttcagcttcttttaaagtaagggcgcgtttctgctgaaaagagggagcagccgcaatcagactttccgctttttccggcgtgcggttgcaaacgtcaaattgtttcggctctctgcggacgattgtcgtaaagatcgctcttgccgcccctcccgccccaatcatgaggatggagagctctgatatcggtttgtccaatactttgactaaggatttataaaacccatctccgtcagtattatacccgatgagcctgtctccctctcttttgacggtatttacggccccgagtactttcgcgctttcatgtatttcatccagatgctccatgatcgcaactttatgcggaactgtgacgttcactccgcagatgccaagcgccttgattccgttaacggcgtccttgagatgacgaggttccacctgaaacgcaaaatactgcccgttgatgttcttatcttgcaaagctgcgttatgaatatcgggtgacattgaatgcccgatcggatttccgattactccgtacaattgtttcatgctccctctccccttctctctatattaatgaacggcggacaaatacgtgtacgcctttcggagcgtatgccgttatttttttatctgcttgctgcaccgtgacccagccgagtccggaaaaaacgatatccgtctttccttctttaatcgtaaacgtgtgggccgtaagctccggaaattcatccaaatgatcttttccgggcggggtaagcagttctcccgcatgcttttcgtataaagcatcagcattttcaagctttgttctgtgaatcatcaattcattcggcatatagcagacaaacgccgttttatcgcctgatacatagtcaaaccgggcaagcccgccgaaataaagcgtttgtttttcattcagctgaaaagtgcgcggcttcagttcttttttcggtgtcagcacctttaagtcacgcttgtccacgtaatgcgccatctggtgatggttaatgattcccggcgtatcataaagcgcagatccgtcatcaagcgggatttcaattgcatcaagcgtcgtgcccggaaattgagaggtggtaataatattctcttcccctgagacctctttaataatccggttgataaatgtggatttgccgacattggtacagcccaccacatacacatcgcgcccttcgcggtaatgttcaatggcgtcaatgacttccttcatcccttgtccgcgggaagcgctgattaaaaagacatcaaggggttttaagccgtattctttcgcttcgcgtttcatccattggacgagccgttcccgctttacggatttcggcaggatatcggccttattaccgacaagaatgatcggattaccgccgacaaagcggttcagcccgtttatccagcttccgttaaaatcaaaaatatcaacgactttgacaattagagagtcagtatcgccgattgtgtgcaaaatatttaaaaagtcatcatccgttaatgaaacatcttgaatttcattgtaatttttcagtctgaagcagcgctggcagatgacattctcttttgtgagcgatgcctttggcgcgtatccgagaccttgtttatcctcggtctggatcgttactccgcagccgatgcaaacaaccttttccattcctaatcctcccactgaatatggcctttacgtttcaaagaactcaatattctccgttcaatccggcggttaaagcgcgtcatgactccgtcagaggaagcgacaggcacgacgaggatcgtatgatacccgtttctgtttccgccgagaacatcagtaagcagctgatcgccgatgaccacacagtcttcttttttcagatccatgctgctgacggctcttttaaaggcgcgccccatcggttttcttgccttataaataaacggtatgccaagcggctccgagaataatttcactcttcgttcattattattggagacgatcgtgactttaatgccgtgctccttcatttcttcaaaccactcgattaatcgaggtgtcgcactcggtctgtcccactccacaagcgtgttgtcaaggtctgtaataatccctttcacattgcgttccttgagcttttccggtgtgatatgaaatatatttttcacaaattcgtcaggtaaaaaaaacttttttaacaaaacccgcacccttccttttctttctatcatctatatgtcgaaacctgtcagatttaaaaacaaagtcggactcagtaaaaaaatttcgacaaaaattgggtttcttcaccagttgtggataaaattacacacattatccactcttattacatccggatttatccagattataaacaagatactaacaagttatccacttacgagtgtggataacagaacgattgttcttatttgtatttcatggtagattaaagataacctcaccatgattgaaacgcaaccttccatcatatgcttgcgtctgatgattgattacaattgtaaggaggtgccactcccattaattgggtccccggcatgagaaagctttctgatgaattactaatagaatcttatttcaaagccaatgaaatgaatttgagccgtgaatttatcgagttaattgaaaacgaaatcaaaagaagatcgctcggacacattatttccgtttcttcttaaacagaaaaaattcccgggcgaatttcctttttttactcagatgactgatattatatcacttcggttatgcgcattactaccactttcaacaaaaaacacccctaaaatagaggtgtttaagaggacggctgctatatattgaaccaatacagaccgcccaggacgagaatgacgacgagcagcacaacaaaaaatgcgtaccagtaccccgcattcacccgaggaggcgggcatacaggatattgcggagggaaaccgcggttcatagcaatcgcctccaaaagatgttttttctacagcctatgaagcagaagcaaaacggtttaggcagctgacggcgtcagcgttccaaaacccgcccattttttatgccttcaattaagattctggcaccttttggcgtcatatgatttccggagggatctatcagtccggattggatcagcgcccggtctgtatctttgccgccgtccgcgcgtataaagtgtttccagttatccaccagcggcactttcaactcagctgcaacctgcctcgtaacgccgttataggaattatgccattttctcgcgccgcctttttctttaaaggctgaggctttatatctcgaatagtaatagagatgatgcgttccgtttccttctataaccgggatgcacgtcattaaaatcggctttatgccgtgatttctgctttcgtttatgaaataagtcaggttttctttaaaccgtttctttgatactcgcggctgatctcccgtcaaaatgcccgcatcatttgttccgaacatgataaataaatattggggcttacgctccagcacatcgctttgaaagcgcaggcgcgcatcctcagtcgtctggccgcctattcccgcatttataaccgtaagacggccgcgttccgctgtttttaaaatatttacccactgctgcgccttcggataatcacgataatcccagttggaaccgcgcgtattgctgtcgccgaacgcgacaacacttttctctttgcccgcagcgcatcctgataacagacaggttatcgtaataaaaagaacagcaaacttcattttctctccctccaaaccttacctcctatggtacacatctctttggcggctttcaacgcggcgctctctttactggatatgaaaaggaccggaatcctgtccgatcaaatccgaaaccttaacaaacgtgtagccctgctttttcagctggggaatgatttctttcaaagcctccaccgtctggcgccggtttcctccgccgtcatgcagaagaacgatatctccatctctggcatgtgaaacaacgtgcctgacgatttttccttttccgggccttttccagtccctcggatcttggttccatgaccacatgatgatatgatagccctcttttaagatgcttttgaaagccgtctgattcaacgaccctcccggcgggcggaataacttgtccccttccggctgcagcgatctgatatgatgcgcggagctgtgaagctcttgtaaaatgtctttgcgttttaaacggtgaaaataaacatggttcatcgtatggttgccgatttcatgtccttcttcaacgatgcgttttgccgttatggggtatttgtctatacggctcccgatacaaaaaaaggttgctttaacattgtgctgtttcagcacgtctaacacagcctccgtatagacaggatgggggccgtcatcgaaggttaaagatagcttctttttttcagaccttatatcccagtacacgtttcccgtcttctccatgtcacttctttttaaagatttcgcatcggcggacacggcagtgagactcgtgaggacgcatatcatgatgatcagatgaaagcatctcaacgtttacacctccagtaaacactactgttaacgtgtccccttttataaaaaatcattctctgcatcaaatgatgtacatccccgcttcccgcttgtttttgtccaaatccgggtgcagccgtttctcatcaaacggcaaatgctgataaacaagtacgcttatcggacagcttattttaatagaaggagatagatttgtgctgtatactaattgaaaagaggtgaacgtacagatgataaaaaagggattcagtcttgccgtcatcattgctgtcgtgatgatcggctttatgcaaaaagacgtctggctcagcatgattcgcgcgggcggcatgtacgccgtgcttatgagtatccttctggtcgcagctgacgtattttttccgatcgttccattcgccattatcgcagccttaaacggagcggttttcgggattgtaaacggagtgtggattacattgtcaggcgcgatgctcggaacaatggcattgttttttctcgtccggtacggattcagagactgggccagaaaaaagctggcggcttacccggccgcggctcaatatgaagattcatttcatcagcacgcgtttacggcggtgcttttcgggcggctgattccgattataccgtcgcttgccatgaataccgtctgcgggctgagtaacatacgatggccgatctttttttctgcgtcggtgctcggcaaaattccgaacattgtgatcgtgaccgtcgcaggcgcttcatttacaagcaacaaactgctgtctttcgggatttacggaatgtatatgctcgtcttaatggcggtcatttataagaagtttcccggtcttttaaaaacaacgagaaaatgaaacgcgtaccgccccctattccggcggtacggctcctctcattctgagaacttttccgttacattctgaaccgatcacttccatgtttttctttctgtaaaatgacagagccgcttcattgcccggcgaaactctcaggtgatattccgaaacaccgttcgctctgaaaaactgattcgcgtattgatgcagttttgttccgcaccctcttcccctctgctgctcagtcatatagtaaaggtgcacataaccgattttttggctgcggtaaaatttgatggaagcttcaagctgtccgatcggctgcccgttatgaagaagcagcttaaaattgtcgggtgagcattagatttgggatgacagccatctgagatattcatccttaataaaatgatccgccgtgccaaagctgacgaaaaacgaatcctcacgaaatgaaacggccgtctctttatgtttgtttacattgatccgcttgaaatacatcgggagtcctcctttttgaggccgcaaataagaacgagcataaaatggctgccaacgccagcataacagcagcccctgcgatgacgatgccgcggacggaagaactgacagccgccgctccgaaaaccgccgttaccaatataatgaagacggcttcgactaatgaataaaagctccccactctccccatgatgtccaccggaacattcttttgataaaacgtcagaaagcctgtattggcaaacgccagaaaaaaagcgagaaggaaaaatccgaaagcagccgtccaaaaaacgtcagaaaacgcataaatcatatatcctgccgctgtgaataaagagcccattcccatcaataaagaagccggcatttttttattaaagaacacattgacaagcgcccccgcaataacccctgccccagagacactgacgagaaaaccgtaatcggcatcagtcagctgaagaacttcttttgaaaaagcggcttcaagcgaatcaagcgcggatagcataacggtcatgaccagactgaataaaaaataaatgatcatgacgtttcgcgccgttcggctgaagcgatagacgagcttccaatcttctttgcacactgccaaagaaagcttctgtgcgggagaatgtacgtggggctcattttcaaggttcggcagcatcatcgtgatgaaaccggacagcactaaagcccccgcattcacccaaatcgcaaaaatcggcgtgccggcgataaaaagcagcccggccgcagccggcccgaggagaaaagcccctgattccgacaaagcccttagtgaattgaatcgttttctcctttcagccggaataagcatcgtcacatacgccatggaacacggtcgaaacatcgcattggccatttgaatcaaaaacacgatacaataaatggaaaataaagaccatacagtaaacatcaacggcagaacggcaatgaatgcagcccggatgaaatcaagcgacatcatcatattccgtttgttacaccggtcgatgatgctgcccgcccacccatttgtcatcaaaacagccgcaggtctgattaaataaaggatggaaaccgcaaaagcagaccccgtttcttttaagacaataagattaagagacaaaaaataaatccattcaccaatatttgctatcccgattccggttaacagaagcatcgggtaccgccaagacttcaggtttttcatcttatccctcccttagaaataaaaaacgccctcaagacaataaagtcttgaggacgggaaacagcccgctatgccacctcaattcggtttggtgccggccttgccgggtacaaagcttactcggtaacaggagtatccgccgcatcatcctcgtttttcatgattccgatgcgaagctaagaggtttgtttcaacacatccattcatactccttcacagctcccggagctctctgtcatgaatgatatctgtctactcgtctcttcagcgcttttcgttatattcttttcacccttactttttttaacaatatacaggctcaatcagcaaaaatcaagaggctgtaagaaataaaacctgcctttgattaatttccctgtacagacacaaacagcctgactgccacatacagttacatataggcttttgcctacataactttgtggaggtgaggatggtgacaggtgtttttgcagcgctcgggtttattgtgaaagaactcgtgtttttagtatcatacgtgaaaaataatgcctttccacaaccgctctcaaatagtgaggagaaaaaatacttagaccttatggctgaaggcgatgaacacgcccgcaacatgctgatcgaacataatctccgtttagtcgcccatattgtgaaaaaattcgaaaacacgggagaggacgcagaagatctgatctccatcggtacaatcggactgatcaaaggaattgaaagctactcagccggaaaaggcacgaagcttgccacatatgccgcacgatgtattgaaaatgagattttaatgcatctgcgcgcattgaaaaaaacgaaaaaagacgtctcccttcatgacccgatcggccaggataaagaagggaatgaaataagcctgattgatgttctcaagtcggaaagcgaagatgtgatcgacaccattcagctcaacatggaacttgaaaaggtcaaaaaatatattgatattttagacgaccgcgaaaaagaagtcatcgtcggccgcttcgggcttgatttaaaaaaagaaaaaacgcagcgcgagatcgcaaaggagctcggcatttcaaggagttatgtgtcgcggattgaaaaacgcgcattgatgaagatgtttcatgagttttaccgggcggaaaaggagaagcggaagaagaagggaaagtgagcaaaaagccggatctgacattccggctttttctattttatctttttcaatcatgactataaacagaatatgcgtagcgctcagtgtgaagggacaaatatacaaactgtttaatcgcgtcaaggcctgtgatgaattcatttgtgatacggccattttcaaaatatattttgtaggtttgagaggtccctatgacttcgctgtcatcttcaatatcatcaaattcaatttctgaggaaagggtcatgataagatcactcctataacgttcctccatttattgattgaatgaaccataataaaaaccgctcctaaagagcgattttaaaatataagaaataatcattctaagaagaaatcgaaagggatttatttactgctttttgagcatggattaaagtcgtatcaaataatggcacttttgaatcgtctgcctttactaatagtccaatttcagtgcatccaagaatgattccttctgctcctctatccaccaaattatttatgatcttcttataaatgtttttggaagactgtttaatttcacccagacacagttcttgataaataatattatttattaattccctttcatcatcatcaggaacaatgacattaatatcatgagacgcaatacgtgatttataaaaatcttgttccatcgtatatttagtacctagcaatcctactgagcgaatgtcttgtctaataatttgttctgcagttgcatcggcaatatgcaaaataggtatagtgatcatttcttggatatatccaagaactttatgcatagtatttgtacatattacaataaaatctgcacctgctttttctaatgatcttgcaacttgacctaaagcttcacctgctttatcccaagctcctatggattgataatgttcaatttccttaaaatcaacactgtataaaaggcattttgccgagtgaagccctcctaacttcttttttatttcttcattgataattcgataatactcagctgaagattcccaactcattccgccaataagaccaatagttttcataacccacctcggataaaattttcaaaatattatagttattctatagcatagattaggtctttacaattatttattttttcaggattattatcataaattttatcgagaataaaaaatgattgcccgccttttaaggagacaaccatcaaattctcacccattttcagttcttcatcttctccagagcgcaaccgtttaggaataataatcaaatcagcagtattattaatttgtcattttcattaagccttatttcaatagatgaaacggaaatcacttcagccggcataatatccaccggtgactcagaatcaataaagtcagaatatagaaaaagagatgtgacagttatgaaaatcatttttctcattcgttactgcattttggtatcaaatgacttgacttataagtccttaacttgcgtcctctctcaaacgattcaacgccggacgctctaaaaagctctcagaaagtccttcacaggcatacttcagtccctgctttctatttgcagacctcgatctggctgccgatgcttgagcccttgttcctcggttgataaccttacagctaatggctatcatcctgaatcttcttcttatacagttttattaaataatgatagaaatcgttatgcattttccagtttgcggctctcgaagattatcaccttctttaaatgcatcacccctttggttatactacgtaataactgtttgtcctacttaggtgattttcaacggtggaaaaaagaaaaactagttactgattagtaactagtttttatcttaaaagattcaaatattaggtttcagattttctggtttaaccatctcatcacattgttcttccgttaataatgtaagctgcacgcagtctttttagcattaacccttccttatgaacaaacttggcattttctaataattttcatacctgataaggttctaattccctaagttgtagtatcgatatcctctgtgtaatccatgggattaaccttttaagtttattaaacctaactgttttattagacaaagcttacagatcgaatttcatagcgcctatcgattttacaatttccggatcttggtgcgacccgaaaagactttctcctttatcaagggtggaaattttttcgatatcctctaagctcaactcaaaatcaaaaatgtcaaagttttcgacaatccgttcttttcgcaccgattttggaatcgtaacgacttcacgctgaacaagccaacgcagcacaacctgggcgacggatttattgtgtttttccgcaatggaagtcaacacgccgttgctgaacatgttattgcgcccttcagcgaacggtgcccatgactcgtgttgaactccctgctctttcataaaagcagcactttctttttgctggcagaatggatgcgtttcgacttgattgacggctggcacgatttcattatgcatgatcagatccattagacggtcgggatggaagttgctgactccgattgccctgatttttccttcgcggtacagatcctccatcgcgcgccaagcgccgtagtaatcgccgtatggctggtgaataaggtataaatcaagataatccagctgcagcttatttaaagatttggaaaatgccgccttggcactttcatagccggcatcctgaatccagagcttggtcgtaatgaacagctcctcacgcggtacgccgctccgcttgattgcacgtccgactgcctcctcatttaggtaaccggaagcagtgtcaatcaggcgataaccggccatcagtgcttcatatactgcgttttcacattcttgagcatcggggacttggtatacaccgaagccgataattggcattttcaatccgttgtttaatgttacggtttgcattgtaattcctcctattgttcaaatgtagaacgacaaacggcacgcatcccgaaaatcgggcactgcagaatgaattccactgcggctggtttgcgttataataagcttattaccttcgtgcaacacgaaggcaagcacttttttaataaatttttaaaggaggattacacatgcatacagtcaaagaagcagcgatgataaccggactcactgagcatgcggtgcgcttttacacggataaaggcctggtgccgagcgtacagcgcaataaaaacaatatccgtttgttcgatgaagaatcaatcaactggctgtttggcgtcaaatgcctcaggcaatccggaatgccgattgaagacattaaaacgtacgtgaatctctgtctcgaaggagattcgaccatcccacaacggtacacactcatgatggagcataaagaagaagcactcgctcagctcgaagaagccaaacagcacattgcccatttggaacaaaaaaccgccctatatcaggccattctggagcaccgctcttttgatacaactaatcccgccaactgggaaaaaatacagcatatgcatagtgacgtattttactcgcccactgtccggtagatgtgaaagatatttatgagcacatcaatggatcttaaactcctaaattggaatccatattgaataggctaagtttgatgacatgttatgagcgattaaatttgtttatacggctatagggctgcaagtccttaatttttttcttacggttactttctattaattagaaattgatagaagtcgcatctgtatgcgacttcttgttcgatgttgttttcaagtgtgtcagttgtttccacgatttaatggtgttcactgacactccgtacttctcggcaaggtccttgtatttcatacctttaaggtagtctttatgcgcttgaatgtactttttagccatctacatccaccgccgcctccttttggattgagttgttttggaaagtaatttctaaaacaactcaattcattacgttgactaaattgcatattctgagtattaaaaagtacaaaaaaaagataccctttgaggtatctagtttataaagtactaaaagaagccattgacataaaaatagagcttaagtgtctattgtccttatttagatcaacaacttcttcgaggcactgctcataaaatttagttccaattccggttaacttccttattacgtgttcattcatttcatgtttcaacatatttaccacggaatattttattagaccatttaaatcacttctatctatactattctttaagaagttagccgtatcagctgtaatcttttttaattgctctccctcaaattcaataagtaaaaaatcgttatcttttttaaaagtaagttcatttactaattttaaatatttttcaaattgatctctgaaattattaggtaaaggcacagaataatcatttatctttaaattgttatatttaaggtctagattattttttttcaagttgcaaattatttcatagcgtaccccagttaatattatcaatttaatgattattgctgatctaaatttattaaaatatcttttctcttcaaaggcatttatatatatatcatctgaatttaatgtttcatcacattgcttaatgagatcattaacctcttcttcaagtaatgtattaaaaccgctactgttttttaatatagagttgtttgagataaattcattcattttatatctatatgatgaatgattgctagctgataaatttaactctctttcaaagtcgaggttcttgatacaatgttcagattggagatacataaaaaatttttttataacaacactatacatataagcagtttctttttttaaaatttttttcttgctctgtgatcgattttcaatattgaattttaaagaatcaattatcctttctgttctaacaccttggagaaaatctataattgtatcatcagtgacctttaaatgtctcagataatctttaaaagccttcaaatgagtgaaatatgtataaggtacactttcaagaaaagactcaaatatttgttccattttactcatctcccatcttattatcgacgaaaaacaatgataatggaaccatttgcaaaatttgtcgacaaaaaagcaccctacaggatgctttattttctgctcttgatgtaattttccttactgatacctaaaagctccgcagaatgctcatcagctgaatgttctaaatggcgtatttggtatttaacgaattcttcttctgtaaatacctttttgtcgatgagaatatcaataagagcttctattgtacattgacggtttaccgatccgcatgctaactattctaacaaatgttgttgattaacattaattgttcttgtcatgctttcacctcctaccttaatatcggcaagagattatgacaaagaacattttgcagaatttgtcgaacgcttatgcattacacagatccttttttatattaaaattatttcaaggctttagtaagctaggtgggcgcggctctcacggttaatccgaccaagtcgaaatccttactcgcctagaggggggtgtggttatggaaatccacttcaaaatttcccgagagtttgcagtcgctattttaattgcaatcgctcatgcctttctccattaggagaaaggttatttctaacgcgaatgattaaacgatccgcaccgacctgcttcccatttgacgctacagattttttcagattcaacaaacgctcaaagtggcaacctaggcataaatggatgatgaactcatctttcattttgtgtacagtttcccttgaaatgccaaggtgaaggccaatagcacggtaactcaccccctccctcatgcaattataaataactttgtgttgctctcctttggtttttccggcgcctaactcaactgcatatactcgttcctcatagtatttaagacgtttgaaaagacgctcttctctcatatccatttgtcgcaactcagcctgactcttcccaggacttccttttggcatagctgcttttaatccatattgagcaacaccctaatttttcataggaattgttgaaccataaagtaccctttgcaatcgatgaacctctttcaccatccagtgatagctattgattagattttcaatgccttttcgattcatgaataggtcctccttttccaaataaaaacgacactaaacaagcagcgtaaataatactataagttcagtgtccacaggctctccgtcttgaacttaatcttttaaatttaataataaatcattcaaatcgcaaataaatttgtaaacaacttcgtgaaattctttgcaaaattccctatttagtatatgtattctgtcacggtcatcaatttcaatataattgttttttctaataatttgaattaattctttttgctttgtttcatctggtatcattgttattattcctgaattgtgaatataacaatttctaatcttagaataatcaactattttattccaaacattgttcgagaatatttctgactctttaaatttctcattacttttatatcttaatttaaaataacttttggctttaaaaatccctctatcatacttaactttgtctaaaattgctttatctaaacatctgcttataaggtggtactctaaaaagctatatatactcgtgaatacactacttctcaaaattgaaggatatgtgctattgaagtcatggtattcatcaatataataatcccaataatcttcttcaatttccgggctcaattcttttgcttcattttcataccgcatttttgatttttcaaatctgtcttcaacatcatccaaatattcaataaactcatttaaaggtgacaaaacccttaaatagaaagcaacacctgatccctttaaaaacatactatcctccagcgtttttgtttattttactacaaaatcacttttaagtgcctttttattaaactatcattcattttaaaccctatctcatgatcaacccgcgcaaagctaccctttacagtttgaatcactgttttaccatgctccggagcatctaaaacatgggcagttccttgattcccatctaaaacaatgatctgaacttttctgggccaattttctgctgaatagtgaagtcttttttgaatttctcttggattgtacactcaatgcgcccccctgtgttatgatagaaggatcagttcatatcaagaacactgaggctaagcgcttcggtgttttttatttttaggcagaaacctcttttatcttgatctccactctcggctctgcgctataaaacttgcttactttcagatccacaacctgactatcatctttgtatatcagatgattcaaagcaccttttacaccctttacgtagttttcaatatcaggcttcgtttttccagttcgtctttgttagaaggctcggaatcaataattcctgaactgtctgcttcattaataactgctttttagaaagaattccccacttactcaaacctgctttttatacagtcttaatagtcatcgcatcccagtcatttttccatccaacatcagatttactgagtttctttttgtgtttctccacttgtacctttgtccagtacactgtttttcggaaaccatttatcaaaaataagctccataaccaatcactacgtctgaattcacacttttcaaaatcaatctcgatctcctcagtcagcggattccgcttctccaattcgccttcatgaatgggtatgcaattgatggacttatattggcctgttcgcaaagcaagctgtatgtaccctttgtatcctagctggaattgggcctttcctccataaggaactatccaggcataccctaagtttttatctataggcaggtcgagtgtctgccacaggaacgcttttcatacatcataataaaaccttattaaaactttacaagacaagctgaattgactatagtctaattagactaaaatattgatgtaaagaagtgaaaaatcagatgataaagtcttttttaatgttgggacagtcgaatatggcgggccgtggatttttgaatgaagtagaccctatctataatgaaaaaattaaaatgctgcgcaatggacagtggcagatgatgacagagccgattaattacgaccgtccggtttccggcgttggcctggcggcatcttttgcagatgcatggtcaaaagctcatcccgatgaagaaattggcttgatcccgtgtgcggaaggcggcagttcattgaatgactggcatccggaaggcatcctttttcagcatgctttgtccgaagcccgcttcgccctccgttccagtcaaatttgcggaatcctttggcaccaaggtgagagtgacagttatcattcgctgcatgaaacttattacgagaaattaactcttatcattgggacgctaagaaacgagttgaaacttgatgaggtaccgttgattattggagggcttggtgactttcttgggaagaccggttttggacagcacgcgactgaatttcgacaggttaatgaacaattgctgcgttttgctaatgaacaacagaattgttattttgttactgcggcaggtttgactgcgaatcctgatggcattcatttagacgcagcttcacaacgtaaattcggttaccgctatttcgaggctttttcgaaaaagcaccatatcctgaaacccatttcgggagaggagcaatcactgaaagtgaatggtgactattctaaaacagaacagatttaccttcatagtatggatttggcttcgggtaaaatcacgtacgcggaatttgaggcgcggatggcgaaggtgatgaaaccatgattcccttacttatccttggcttgctcatccaaaaccccggagctcacggctatgaacttctggctttaatggaaaaacgtcattacaaatacattgttaacttcacgaaaggttcattttattacaatctgcagcaacttgaagaaaagtgtttgattgaacagattcagcagaaaccctcaaccagcgggcgtgaaatccgtaactttaaagtcacagattcgggaagggcagaattcgaaaaattaatgatcaaatacggcaccaaatcggaatatgtgaacctgcaattttatggggcgttactctttgccgatgaattcgacaaaaataaattactggatctgatccaatcacaaatcgatcagactaaaactcgaatcgagctccttgatgaatacctgtccatcactcaagaaattcccggcacaatcaattactttcgccgtatgaatgaaaattcccgttcacatcacttggttaatttagagtggttcgaaaaattgaaagcagaaatagagtgagctattgcataataaaatttcgcatcgtcggcattaaaaaaaagagtccctattttgttcaaaggcgtgaatcctgacattgcagcgatgtgggaaagtttagatgaagcagcaatcaatcaactaaaagagctttctaatgcagcgcctgcaggactcatcagtgcatccacgaacttttctgaaggccggacagaggaaaacggagagcttgatcactatattggcgcagccacaacgaaacattgcccaaatcatctatcacagcttgaagtccctgcctcaacgtgggctgtattcaaagcagccggatcatttccggatgcactgcaggaagtatgggggcggatttattccgaatggtttccatcgtcacattatgaacaaattgaaggcccagaaatcctgtggaacgagcataaggatgtaacatcgccatcttttaaaagtgaaatttggatacccatttcaaaaaagtaatatatctgacaataaaattagaggaattaaaggttttaaggaaggggtcttatcccttcctctttatgtcactaacccgatctgcggcaatattgatgccactaatcttcgaattgagttttttaatgagcagagccgatcttactgaaaatataaattgaggtgtattgcgttttgatgatctgcttctcacttcttattttccgccttaacgtccgatcatttctgcaattcttccccaaagtctgacgttgatgattgaccgccaagtctcccgttttgattcctgccttcacggtttcccgaagtgagttctctattaattccgctgcttctttccggaaataaatcacttcacaacagacaaactgaaggcggtataaaaaaacagctccgttaaaatggccggaactgtctttgaattttggattttgcagttatctccatccgttagtttaattagaattcagataatccaagacacgatcaactttttcattgactgagtaatctccttcaatttttaacaatggacaagataaatctgccatccaatgttcgtgtaaagctttgcttctaacttccattccggcatgatcatataaagaagcccactctaaaaatgtttttgattgttcatatttactgccgccggctaacacttcgtttccataacgctgaaattccctatgccttaatctctcaagccgtatatcctgcggaatccataagaagatgacaaggtcaaaataactttttagatcatcgccccagcggcacactgcgccagaaagaatccatttctcatttattgtcaagtctttttcaagcaactttcttctttcagggatttctctttttttagtgaatttatctgtccaatagtaatcatccgtatcaagatgcgtatgcggcaaatgctttgataatgcaacacccaatgttgacgttccgactccggaggctcccaatatgtgaatcttatttttcatacttccccctccttatgaagcaacgaaactccctgtccgctgcacaaggttcttactattattttaacataaatccccaaaaacctttactttgccaggggaatccagatgcggttaaaaccataccgcttacgaacttcatggtcattttcaaacagaatgattaactttctctccggcctattttaatatccctatacactttttcaaaagtctcgattggcagtgaaaacttggttgttttctcgttacggtgattgattacgatctcaatttgattatttttttgttcaaactcaataagtgcgttctcccatttatctctgattgaaatgatacaatttccatttttcttttcctttttcttataaatgtaattcactttaacgcccctttcattgatcggcaaaaggtttcggaataaggaagctcctcaaaaaaaggatcaaaacttttatcaagtttgatccttttccctttttagtcatttcttcgcgaacgtttatagacattcacggttaccagccagctcataacaacgattcctgcaaaaagaatgagcatattactgtacaaataagcggaatgatcagcgttaacaggcagcagcctttgatccagcaagcggatcgataataaaccgcctgcaatcgaaatacccgttccctctgataaaaagctcgtaaaattaagcagactcattccggcgccggcttccttttgtttcaaactgccagacacaattgtagatataaccgtttttgtgaaggagagccccccaaaaacaaaaacgattataacggtcatgagccaaggtgccgcatctatgaaaaaggcagcgattaaaaagctggaagacatcaatacaatcccaatggtcagcacatacaaagaacctttccgatcaacaagcaatcctccaatgtaaccgaagatgatgacgctcatcgtcccggggaacataatcccgcttccaattgccgcagtacttaaatggtgaacatctttcatcatataaggaaccatagacacaaatcctgcagcagtgccgaatatcaggcctccgcaaaggacgcccatcataaacaaaacatttttccccagtgcagggtcaacaaagggatcttgagttttcctaatatgtctcacaaatatcaggaaagctagagtactgatgatcagaaaagatagtctatatgacgttgtaaacagcagaaaaaatacgatgcctgcagacattaatataatccccgtcatatcaaagcgcccgctgattctttcttccttttccagcagtttcatcaggaatggaacggtgataactgttgctgtcggaataagcagcaaatatgaccagtgaatataatgagcgatcattccgccaatagctggcccgacaccttcccccattgccaccagcgacccgatcagaccaaatgctttacccctgttttctttcggaatatagcgtactactgcaaccatcacaagagccgggaatgcggctgcaccagccccttgaataaatcgggccagaatgagtacaggaaagaaagagtgtccgacaaatccaatgatcgacccgaagccatttaccataattccaaataggagcagctttttgatgcccagctgatctgataacttcccatacagagcagttccgatggaaaaggttaacataaaggccgtgttcacccagtttgcactcgctggaagtttatgaaaatcgttggcgatatcaggtaacgagacgttcaaaaccatttcatttaatacgctgaaaaatgacagaacacaaagccaaatgaacacttggttgtgccgtaaagctgactgtgaataaggcgtattcacaaatttccctccattaatgagggcagacgcagtttatagggccattgatacgcttccctcttttaattgtaccctgttcatttttttgcacttcatacataactccccctgcattgattgatataccttattataaatcctcaagccgatgttttgaatactttgcggcacacacccgcaaataacgaaacatcaaatactgttatatttaaaatttacagtaccaaaaaaccgcaatttcatttgctgttgaaagattggaataaagcattgtatcgaccgctcctatgacaaagttatttttggcataaaaatgacaagctgaaacattaatatcttgtgtttcaagcataagaccgcataaatgattctcctttgcccactcaatcgctttatgtaataaagccgtcccgacaccattttttctataatcttttgcaacggcaatgtcttcaatcagtgcgtatccattccaattagaacgaagcttactccggccgacacagtcgttctctgcgtaataaaaaaagacaactttatcctcttcttcaatataactgacatcaatgtcatcatcgtcatattttttgacataaggttcagcaaatttctcctctgtatatgtccaaacattgttttcaaatgaagggatgattctccctgaaacaacgaaaggttcgtttggtttattgaagtctttcatattgaaacgagtcattttagttatcatcataatcacctttctgcatttattgaccttaatttacatcttttgaactgttgattcgtctgcatgtcaagataccggtttaatcactttaagactaaaacaaaaaagataccaacatcgattggtatcatctattcattcgagccctgcaacaacatcctatttcggagcttccaaaccaaatgttgtccattcctcttttgccggaccataaatacccggaacaggtaaacccgcttgtctcataaggacagtcatttgtcctcgatgatggttttgatgttgaattaaaaacatcaaaagtgaaccatttggcaattgctgaccaataaagttgacacattcttgaagtgtatcatcagtccattgcgtttttaacgcctgtacaaatgcattactggcttggtgataactctcagcaataaaccgcgccgatgcaggaacaggataatcttcagcaggagcgtggaacgttaaatctgtgtttgaggtaatgatgtgaatggccgcaacagtatgccatgcagtacggcctaaagtccaatgttgtgaagtgatttcttgtttaagagattcatcagtcagtcgattcagcagtttttgtgtcgcgtcggcttcgaattcccaagatttcaaaaaatggtctaaggtttgaaacataaaaatcctccttatccttttttgtttttctatgtatctgcagttcaattatagtgctccgtttagttaaaaaagaacaaaacgatagacagacatgacaataacagacaaaatataagaacataacagatcactctatacttccttttcttcaatcgacaaaaaaggatagctgttcaaacaggattcttcagtctaatattttcgctttgcaaaagtccatatcgtcttagtgattgaaccggagataaaacagctccccgtcatcatagccacccaaatgaaaaatgtcggttcggcacctattacaataaacataaatatcaaggacaaaatgaatacaataacaaccatcatccatacttttttgaaaatgaaatatcctaaaatccctaacagaaaagaagctgccggaagaaaaatgagaatgatatacgcgggactcaacagcgggctaatacaaacacctcccaatttcaaaacgaggaagttcctactttttgtctgatatcaaatgatatgaagtgatttttttcatcttgatattacgccgtttcattcattttatacatattataccaataaaaccgagtcaaatatagatatttattcatttttaacatatttccggaaaatgaggagtgaattaaagtctgagaatagcccgctttttcttttcctagtaagtcctgcctcattggctttagcccatctgctttctcattgtttttgcagcgctaatattctcataatcgtgtgcatgacgctgctttcctcatttgatttgatgacaaagtgcgccgcatcttttatttcgtcaatggcgttcttaaccgcaaagctgtaggatgccgcttccatcaattctttgtcattgcggccgtctccgaatgccattgtttcatcagccgaaacccctaataatcgttgcagttcttgtactgttgatcctttatgtattccgatatttgatatatccatccaggtatcttctgatgctacgatatataattggtgaaaaaattcatgcagcttttctctcgtttccggacagttggcgtcggggtcatgaaccgtaatcttgataaaatcgtcttttatctcagtaaaatcagttattttcgttacatgtgcataagaggcatttacatatttcatttcactttcagacagattttcttttacgatcgcgcctttttttgtgcacgcgataatggtgtgcccgcagctgattttttctaaagcgcctataattgacagtccggctttattgctgattaaagattcatatacgaacttgccgttctttttcatacgtgcagcactgtctcctaaaatccaaaaatctttcgcgtcttctccgaataaggcttccaccctttcacactgtttcccggtgcagatggcgaaagcgacatgctgttcctccattactctttttgtcttttcaaataacgttctgtcaaaatcgccttgattatttaaaaatgtgccgtctaaatccgtaatcactaatttaatcatcgttcagcacctccgcagttaaaatgtctttttcagacaaagggtttttcacatttgagaatggaatcaatcgcgtttaagaccccttcctcattgtttgattgcgcgatatgcgccgcggcctgtttaatgctttcctgcgcattatccatggcgactccgtatttcacggcggacaccatctccaaatcattgccgctgtctccgaaggccgcgcattcttcagcatttatcccccattgtttctggagaagcttaatcccgcttgctttatgaagccccggtatgatcagatctatgtcaccgtgcccgcttgatacaggcgtgacgaaagacccgattgcgttttttaaatggctcagaagtgcggaacaatgttcggcgggaaagctgatggaaaattttaaaatgtcatcatcgatgttttcaaaatgcggcaccctttttaacacataataatacttactggcatgcagatattcatcttcactggcattttcatgaatatacgcgcttttttttccgcagacaatgacgtttttcacctcatactgctctaaagcacggattactgcttttatagtgtcttcagacatgctacctgcgaatacttcttctccggcattcacgacgaaagcgccattctcggcaacgaaagcgatttcacttttgatttccggaaagaaagatgtaagctgcgcatattggtttccgcttgctacggcaaatttaattccccgcgcttttaattcacgatactgattcataaaacgctcttcgttatatgccatttcatcattcaaaaacgttccgtccatatcaaccgctatcagtttgatactcatattgtcctccttttttcggccgcttttgtcagcgccccttgaagagatcatgcataaagcgtatgaacgaattatatccgcagttgttttgaccgtaaatcattggctgacgtcttgttttgaatgacacaaaaagtgatttgtcacataaatataacactatgtttcttttaaaaatgatatgttacgatgagatgtacattcaccattctcataaaaaggagaatccccctgcatgttcacacacgaaatgattgcttcatttaacgagcttgaaacttctttatacaactacatctcccaaaacagcgagaaagtcgtctatatgcgcatccgtgaattggcaaatgaaacccatgtatctacggcttctattttacgtttctgcaaaaaaataaactgtgaagggttttcagagtttaaggtgaagctgaaaatgtatgcggaggcaaataaaaaaacgattttaaagagtccccatcattccgttgccgagttttttgaaagaacagtaagcggagggatggaagaaaagctgaaggaagcagcagcccttgcggccgatgcagaaagcgtcatttttatcggagtgggtagttcaggaattctcgccgaatacggagccagatatttttcgtgcttagggaaactttcaatgtatattaaagatccttactttccggcccattcccatttccgccataacagcatcacgatcgcattatcggtttcaggtgaaggagattctacggtgactcatctgaatcagctgaaacaagaaggaagccgggtcatcagtattacaaatcataaacattcaaccattgccaaaatgtccgatgtgaatatttcatattacgtgacggaagaatgggttgaaaatgcgaatatcaccacccaaatccccgctatgtacatacttgaatcaatggctcgggagatatacaaattgagagaataaattcaggaacggaccactgacacgttagaaatttcggcctttttgtaaaagtaacgagaaacccttctctgctgccagagaagggttttgaagatcacagatgagacacaatacactttgcatggcccgccagtttatattctcccaaaccggaaggcaggagaatgtgatctccttttctaaagggatgttcatgcccgcctgcaatcattattccgtctccttcgatcacgctgacaagaaggaagggatgattctggaataaatttgcttcaccttttacatcccacttttcgactgaaaaataaggacattctattaaaacagctgccagcagatcatctgtttgtttatattgaacggtcggccgttcacggacagctggaacgtctgtcacttctatacttttttccaaatggagctcgcgcatcctgccgtccgcatcttttcttccgtaatcatacaatctgtaagtcgtatctgaattttgctgcgtctctaaaataagtgtgccctttccaatcgcgtgaacggtgccgcttgggacaaaaaagaaatctcccggctttaccttaactctgttcaggagcccgtcccattctccgcgctcaatcatggatatcagttcttcttttgttgttgcgctgtggccgaaaatgatctccgcatctttttcacaatcaatgatataccagcattcggtttttccaagttccccgttttcatgcattttggcaaagtcatcattcggatgcacctgaacggacaggtcttggtccgcatccaaaatttttgtaagaagaggaaaacggtctccttcaaggtttccgaataaatctctgtgatgctcccacaattcaccgagcgtacatcctttatacatgccgtttcgaactgtgctctgtccattttgatgagcggcgaaggcccagcactcccctgtccgctcggacggaatattatagtgaaaatcacgcagggcggcgcctccccaaattctttctttgaaaaccggattgaaaaatatcggttcagtagacatgatcatccctcgctttattcgatttcttccagaagctcatacgcctcttcttttgtctgaacggagagcagcctttcccgatagctgtcatccatcagttttcgggataacatctgcaatattttcagatgctgatttccgccgctttccttcggtacagcaatcataaaaatcagttttgcatcagaaccatcaaggctgttccagtcaacacccgaacgtcttattccgaatgcaacacccggcgttctgacggcttcagactttccgtgcggaatggcgatattcatacctatcgccgtggttccctgctgttcacggctcaaaatggcctgcttaaatccgctgtcagacagcagcatacctttacgggacaatttctcgatcatttcatcgataatgtcatccctcgtttcgccggataaatgcggttcaatcaagtccgtgctgataatgtcagtcagttttttgatttcggtcatcccggcttttcggctgtcagcctgagatggttcctttgtttcttttgccgctgcagcttcatttgatgcggcagacggcagcacctcaccgggcgcgggggatttcgccatatctttcttcagtacattaaccaacagagcggtgacaagagagcctgctgttacagcgataaaaaacatcaatacatgatctactgctccaagtacagcaacgatggggccgccgtgtgccactctgtcccccacatggccgatcatcgctatcaccgagccggtcatagaacccgccataatactcgggatcactcgaagggggtcttgggccgcaaatggaatggctccttccgtgataccgaaaaggcccatcgtaaatgaagcttttcccatttctctttctgcggcggcgaattttctttttcctaaaaacgtcgcaatcccaagccctatcggcggtatacaaatggaaacggcaatcgggcccataatttcataatttccttctccgatcattgccgatccgaatagaaaggccaccttgtttacgggtcctcccatatcaaaggaaatcatcgctcctaaaatcaatgccaggagaattgagctcgagcctttcattcccgcaagccaaaccgttaatgatgcgaaaatatgagcgacgggggcgccgatcagaaacacaaacgccaaaccgacgatcagtgaggcaaacaccggaataataatgatcggcataatcggctgtattgctttaggaactttacattttttgattccaagcgccgcatatcccgccaaaaatcccgcaatgattcctccaagaaatcctgcgccgctcgcactgtcgtaaaagctgccggatgccgcaatatatccgccgatcattccggggacaagacccggcttatcggcgatgctgaacgcgatgtacccggctaaaatcgggatcatgaatgaaaaagaagcgctgccgatctgttcaatcgttttccaaaaagacgcatccggaatgactaagccctttggtgttttttctcctccaagcgtcaatgcaaccgctatcaataatccgccgacgacaatgaaaggaaccataaaagaaacgccgttcattaaatgacggtaaatcgggttttgttttttgccctgctgacttgcggattcagtttttgaagcagattgatagaccggcacttcaccgctaagcgctctttgaattaattcttccggtttgcggatgccttcctgaaccccgacggccagcagcttttttcccgcgaatcggtctttgttcaccgaacggtccgccgcgataatgattgcgtctgcttcccggatttcctcttcggtcagcctattttccaccccgattccgccctgggtttccactttgatctcaacgcctaatctgccggctgctttttgtaaattttcagcagccatatacgtatgggcaatgccgttcggacatgatgtaatcgctaacagtttcatataaattctcctttgcagtctgaatttcaagatcttgtctcaactttatactgaaatcagcctgtgataagcgcgtttttttaccataagttccggaaataacggcatttttccctataaacagaaaaaaagcagggagccattccctgcttttaatagtttaaatacgataaaaacgtcatcacatttttttcttccgtcagtttttgaataaatgccggctgctcgctaagataggaaagctcactgaataattgctttaccttgttttgatcttcgtgtttgacggcaagcataaatacaagcgacaccttttccgtcccccactcaatgggctcttttaaggtggcgattgcaatggctgattgtttgatatatttagagttcgcgtgagggatggcaatacccgccccgatatttgtcgccgacattttttctctcattactgcatgaatgccatactctttttctacatagcctttttcatacaaagcctgcgccagctgttcaatgacctgataacggtgctctgtctcttgctgtaaaaaaacgagaaacggagtcgtatcattcagcattttaaacgttttttgctcccggcggtatgatgtatcaagctgttgcataaatgcgctgagcttcttttcatcagcaggctccaaaagcggtgatacgacgatatgagggatcgttacatttccaagctctatcgtagaaatgacgaaatctatatctttatgctttttgatatactctgtcagctccgcttttgcgatacagtcttttatcgtaatgtgatgaaatttgcgttcaattttagtccgcagcaattgcgacatgccaatgcccatatggcagacgatgatcgtccttttagggttatgactgcttcggcgcagccgttcgatcgctgcctgaaaatgcagcgtcaaataggccgcctcttcttcaggaatataaagatcaaatgtttgattgatgtcttctaaaacgtcaatgataagatgaaacaaataagggtacatttttttgatatcgtggagcatggggtttgaaacagagagatcatagctcagccgcttcaacaccggatcgagatgaatgttcaatccgttgatcaattcctggtctttgtgaaaatccagcattttcagttctgaaacacgattgatcaaatgcctgacgactttggaaagctcagaatcttcaagatcaagtttcttttcttgctgcaatggatagcggactttcccgcctattatatgtaaagttaaatagacggcttcttcctcgggaaaccggatggcaaataccggctcaagccgttttaaacaagccagtgtccattcatattctttcttcttttttaccgcctccagctgtcttgcagagatggcgaccggctgtttcattttgatacggcggatggtcagcaatgtatgcagcagcaaattttcaaatgtttcatccgtaaaatagatagaatggtttttttgtaataacttgatttcttttctcacaaagtccgcttcatgacttaaaaacttactttttataaattggcttgtaaactccgcattatcaatcaaatctgaaattcgcgccaatgcttttcttttgtttttttcgtccccttcaatctttaagccgagccgctgtttagaaaccagtatgaggtcaaatcgcttcagccactcttcaaccgcactaatatcctttttaatggaagctctgtttacaaaatgctgtgcggcaatttcttttgcggaaacgggctttgaattcattaataaatcataagcgatgtgaagtattctttcttcatcggtcttgtgcctgcatgtaaagtgctcattataaatgtgccggcttaaccgtgacctttcctgttcagatatatgtaaatagacgcctaatcccggtttgcggatcagctgagcttgagcatgttcattcaggaaatcttcaatcgttttcaaatcattcctgatcgttttttcagaacagcggaccctgtctgcgaaatcttgcacaactaagtagtcatcaggttcagataacaacagatacaaaatctttttctgtcttgaattcatgtatttcatctgtttttctatccttcctgtccgtttctgctggagcaattatgataggttaaatatactgcgcatacgaaaccgttttcattgtatagtgaaacaaaagagtaaaaagttttgttttttaccgcagattccggaaaaatcatgttttatactgaggctgttcacctttggttgacaacaaaacaccaaccgtttttaaacgattggtgtcggcagaaaacctgctgttacagccaaaatgtttcgccaagcgctaatgctttcaggttttcaggaggtaatgcacgccggtcccactcgctgtgcagtctgcttaatgcttccgggcctgtatcatcagcaagccggaatgccccgtaatgcatgggaatgaagctgtcagccttcagctccaaaaacgctttcacggcgtcttccggattgatatgtgacactttcataaaccattcgggttcgtatgctccgatcggcatcagagccgccttaatacgaaacctctctccgatttctttaaagccttcaaaatagcctgtatctcctgcaaaatagatggactcgccgttttcgctttctatgacccagcctccccaatgagaggtatcggtatcccaaagcgttctccgtgtccagtgctgggccggaacaaatgatatattcaccccccgcatctcaaaacgatcccaccaattcatttcatgaacctttttgcggccttttttgatgaacagctttttcagtcccgcaggcacgtaaaaatccgggtttcctctcagtttttttatactcggaaaatcaagatggtcataatgcccatgtgagatgagcacggcatcaatgtcaggcagttcgctcaattcatatcccggctctgtcagccgtttttgaaaacccatcctccgcgcccatacagggtcggtcattatgttaagcccctgtatttggatcagaaatgaagaatggccgatccatgttatggcggtttccgtccgattgacggcaacatcacggacatcccttttgaccgctttcggaatgttctcgcttaagtctttacttttttctcttcgttctttcatccatttccacatatctctgaatccatgttcattcttcacgccattcaagttttcatatctttttttcattatcattctcccttgaaacgtgtattccattagattcatcggacatttatacaatgtctgtaaataccgctccgcttgcttcggctaaatcttgaggcgctactttcagctgcattccgattttccccgcactgacaatcataaaccccagtgtttcagcggatctatcaataaaagtcggaaacctttttttcattccgatcggagaacagccgccgcgtatatagccggtcactcccaaaaggtccttcatggcaatcatttctattttcttctcacctgccgccttcgcagcctttttcagattcagttcttttgcaacgggaacgacaaagacgtaataacgatcagttcctgcagatgccactaaggttttataaacatattcggcagagtatccgattttttgtgaaacggaaagaccgtctgcgggctgtcccccttctgttttgtaacctaatagctcatagggaatgttttgctgctcaatgatacggacagcatttgttttcactgtttttttcgccatggttatcctccgttttctgtatttctttctgctttattttcaacttcgattttaataaaatgaccgctcagttgcgtgctttgtaataatcaagtgcaaactgtttaaaacgctcagcagcgggagagagagcatggttttttaactgcgctaacgctatggtgcgttcgcattggtaatctgcaaccgggagaaaaacgaccggaaagtatgaatgctccgcggttttcggcagcactgcagccccaagacccgcggcggtcagccctaatatggttgacacttcctctccttcaaatgcgagatgcgggtgtatattcaaatcccggcacatcagatcaaacatatacctcagcccgtatcccggtttaaatccgacaaaatcctcgtcctgcatctctttcatttgaatgcttttatttcctgcaagcgggtggttctcaggaagcaccgcataaagaggctctttctccagcactgtccattgtaaaagctcgctgggaagcggcggggagctgagacagatatccgcatctcccgtttccaccattttgcgaagcgtttcatttgcgccttgataaagccggaaggtcacgtttgggtatagctttttaaattcggcaatcagctgaggcattaagcgcagcccgagcgtatgaagaaaagatacagatatttcgccgtgttccaggctcatattttttttcacttgttcaacgccttcatttaaagctcgtctcgcttgttttgcttttattaagaactgctctccgtgccttgtcagccggacggcttttgtctctctgtaaaataacggcgcgcctaattcttcttcgagcctgataatcgatcggcttaatgccggctgagaaatcattctttcttttgccgcgtttgtgaaatgctgatgagttgccgccgcaatgaagttgtcaatttgatgaagctccattttctccttctcccctttcctcataacctacacgcattaattctatagttattataaattagacacattgaaatgaaaagcgtacgatacatatataaccaacagtgagaaaagagggacattcatgacgtttattcagcctcatacaaaggcttacagaaaggccagcttggctctgtttatcagcggctttgtgacatttgccacgctttacacgacacagccgcttatgcctttgttttcggaagagtttcatatttccgctgcggctgccagcttaactttatccatctcaacagccgttttggcattttcattattggccgccgcttcgttgtctgacggattcggcagaaaaaaattaatggtgctgtcgttaacagctacttctgttttaggtctattaacagcgttcagtccggcttttccggcgcttttggcgatgagggggctgctcggtatttttctggcaggcgttcctgctgtcgctatgacatatgtaggcgaggagtttgatccgaagggcctcgggaaaatgatgggcttatatatcagcggcacaagcatcgggggaatgagcggcaggctgttaacggggcttctgactgatgtattcggctggcggccggcgcttgccattatcggcattctttctattgtattaagctatttgttttggcgctttcttccggctccgcgccattcatctcagcggcatgcgggcgtaaaagcggcatgtaaggaatacggagcggttctacaccgcaaacggctgcttttgttaatatctctgggatttatattaatggggagttttgtgacattatataattatatcggctttcatttaatggcggctccttatcatttgtcacagactgtgatcggttttatttttattgtctatctcgcgggaacgttcagctctgtctatatggggaaaaaagcggaccttttcggaagttcaaaaatgattaagattgcgatttttgttatgctggccggtgcagcggtgacacttttgccccagcttgcccttaaaattgcgggcattgccgtgtttaccttcggctttttcggcgcgcattcgatcgcaagcgcctgggtcggccgcgcagccggtgatcagcgcgcgcaagcctcttcattatatctgcttgcatactatatcgggtcaagcgtggccgggtcttgcggcggtttcttttggacgcattttcattggatcggtatcatttcatttatttcggttttgctattgctgtcttatccggttttatttctggcggaattcagaaaaaagggacatagccgcctgcatgtaaatcaataaaaacattaaagatttgtgtcttttgtccgatactaaagataaggccggcacgatactccctataactattccttttgattcagtagatttcaaatatcgtgccgactttcttcaattaaaacacaatcttcaattgccttacgcttctgttacacacctgcccaaacatctttcgcatatcttccttccgcctgcagctgttcaagccaattcgaggaagcttttgaatcagtgttatgcaccttttcatacgcctgaagcagtacattttcgacagccggagccattttgcttccgtctccgcatatatagagatggccgccttggtcaagaagcgcaataatctgtgcagcctcgcgaagcaggacatcctgtacgtaaactttacagtcctgatctaatctggaatacgcccgatgcacggtgacaaggccgtttttctccgcatggtcgaattcatctttgtacagatcgtcttcttcaggatgtctgcagccgaagtataaatgagcttcgcccaggctgttaccggacattttttctgctgcccgcgcctggataaatcccctgaacggtgcaattccggtgcctgctccgatcataatgagaggcgttttcgtattttcaggcaatgcgaaacccgactgcggcgagcggatgaaacagacggcagaatcgccattttgtaatccggctaaatagttcgaagccacgcccctgtattctccccggccgctccacgccggagccgtcacaacgccgaccgtgatactgagctcccttttgtttgacttcggtgagcttgagattgaataatagcgcgcctttaaggacggcagaagttctaaaaagcgctcaaacggcagttcacaagccggataatcttccagcaggtccagcatggtcattcgttttttcagcacgttttctttatatgccgcatcgtcagaataaagatgctccaattctttttggtgcggcgggcacacggtatgggcggcaagttcgcgaagctgggctctcgttgccggttcctgcagctctacatatgacgccaaaagcgccggcgcattaaccggccggtccatcggcagatgaggcagctgccggcccttgatcttaaagtgctggttcggatcaagaccgaatcggcgaatgacacggctgatcagttccccgctgttttgcggaagcaccccgagatggtctccttcccgatacgtttcggttttcgggagacgcagctcaatatgccggactgaacgcttgctgctttcggtatgaagctctttgtttgtgatgacttccgcctcaaatgctttgtacgttttggcaatcggcgtctcggctgcttcacttacgtattcgattgataactgtgatttgtttgcctgttttggagcggcctctatatgaaaagccttcatgatgtccttccagaatgagtcttcccaggcttcctgactgtactcaaaatcatcggcattgtcgccctccccgatagaagtcagcctttttgcccctttttcttcaagcactttgtctatcaggcgggggatcctctggtaagtggcggcccagttgcggtctccgcagccgaagacagcataagaaacaccctttaattcctgatcttcaagggtttccatccatttcacaaaacccgccgcattatcaggcggcgccccgttataagaagccgtcacaataacgactgcgccttttacaggcagtttccctgcataatcatcgagcgggccggtttcagttgaaaatcctttgcttctgccgatgtcagccagctcttccgcaattccttccgcagttcccaaatttgaaccgtaaagaatgagaagcggcgttccgtgggacggtatttctttcgtttcttctttgtgaccgctgccttcagctttatggttttgtgcggactgctgattggacacatccttgtttttcacacggattttaaaatcaccgggcttaatggttaaagcttctttaatcgtaagctcataatcagtatgatcaatcagttcaaagtgtttaaggacaaggccgagcaccattgtcgcttcctgcagggcaaactgcatcccgatgcatgcgcgctgtccgtttccgaacggcttatacgcatcagccggaattgccgcgggatcgctgaacctttccggacggaataactcggcatcttctccccacgcgcttttatcccggtgcagctgcggagtcagaatcgtcaccggctgtcccttcgcaatcggatatttcccgccgagaaccgtatcttctttcgcgtacagggaaaatgccggggcagtcggatacagccgcaaagtctcgttcagcaccatgcggatatatgtcagctgctgaatctgcttatattcaggtgtctctcccgtcagcacccgctcggcttcctgaacggcttttttcaatttatctttatttttcagcaggcagtatatcgcaaaagaaagcagcccgcttgtggtttcatgccccgcgatcaaaaaggtaatgatttgataacggatattttcatcatccagcctttcccctgttacaggatctttcgcttcaagcatcaatgctaaaagatcagacagattctcatccggattttctctccgctcagcgatgatccggtctacgagttcattcatcacttcaatatcctgctggaactgatgtctcgttttgatcatcagcttgtcctgcaggctgtgtctctgtgattggcgcattgcctcctgcagcgcgcgaagcatgctcgtgataaaaggatgctgtgtgtcgcggtaaaagctgttaaagcggtaatgaaatccgcacaggccgattgtatccagcgtcaggcgcgtcatatcttcagcgacgtcaatttcttcattcggatttaacctgctccacttctgcacgagctgcatggcaatatcaagcatcattgaatgatagcctttcatcgccttctggctgaagctcggcaataaaatccgatgcgctttctgccaattcttttcgtgagtccagctcgtaaatagtccgtcaccgccaaactcacggactttcagcaaggctttgctgaggtttttatcaaatcgcttttcatcacagacttctgccgcgagctcgcggcctgagacgaagaccccgacagagctcggaaattcaaaacgaaagatcgggccgtattcttcggcaattttccagagcgattgtgacagtttttctttttccaagtgagggagatttttcagaggtccgtatgttttcggctgcggtatagcgcttagctgtttcatatcgatcttccttccttcggcgaataattaatgagttctgatggcatcccaagaacattgttccagttctttcagaaacggttttgttatttcgacgcttcccgtccgaataagctgatagagtttgagatatgccccgagcagcagcgccatcagcacattggacggcagattgcggagcacaccttcagacttgccgcgctgaaaaaagacgtcaagcatctgtgttatttcatcaagaagcttacggctcgtttcattcagaaagtaggcgtccttattcgtttcaagaaaaaacaatgcatactcactttccttcgtaaaatcaatcagacaataaaacaggtgatgaaacccttctcttacagagataccctgaaagtccgttttgacttttttcataaaacgctgcgcactttcctgatacagtacgttcacaagtgtctctttactgtcaaagtaacggtagattgtgccggttccgacatcggcctgagcggcaatcatcggaatcgtcgtggcgtcaaatcctctatctgtaaacaaagtaagcgacgctttcataatgagttcaaccttgtttgaagctgtcatttcatccccctttctaaatgcggaatgaatgttcattccgtttgttcaaaatatttaaaatgtacggtcatctgattaccattgtataagaaaaaaactttttttaatataaaatagatgtgaaataaccaaaaataaggaaatatgcccaatttcacaaaaagagctgcagtgacttaagcagctctttttatttcccaagaaatattctatttaatggcagtaataaaatggaatgaatctctgctgacaactgaaatgtctctgaaatgctgatcatagagcacctgaatcacatccttctcactcatccgcgaaggtttcaaaaccatatagaaacatccgtcaatttgaagaacgcggtacacttctttacatgctgtcctgtaatcgctgactgtttcagcagtatgtaatgagaaaactttatgaaagctgcgatcgcggaacggtaagctttcaggcctcccctgctgaatgtttccgagcccggcttttataaccgaacggtttgcgcgctgtgttttccgtattttacgtttcgatgtttctatccttttaagactgcccttttcaagctgtccgatgatttgtttaaacattgagccgtttccggtcccgatttccaaaatgcggtcgtattcctgtatgtccatcaatatttgctgaatgactgactctgccggttctgatgcagcaaagtatttcgcgcgcattcgttttaatgctgaagatgtatgttgcaacattgtataacacccgcttttccattcctgtgatttattattcagaaataatattacctcgtattagtatgaggtactaactagacgcacttctcttcatgaacgtttcgatttatttgaaatttatatttgttttcataaaaaaaagacggaaaacgtaggttttccgcctgctctagtaccaataatacggtgctatatatcttgtctgccgggaaagcgccgccattctctgccggcgatacgggttgccgtagccgtgtttaaatgaatggggcattgacgcatacccgtgcccgatggatggaattctgttctgaccgccttgcatgctatcacccgcttaccaatttttctttctttaccatggtatgcaggccgtctgcgacgtgacagcaacatcctcgctaaacctggtccttctccattgtgtaatgattcagcagttcaattctgaacatgatgatctcctccttctcctccgttttggcccttcgtgtccgttcagttcatataaaagtgtttcagctgtcgttctttcgcttcattataaaactcttcgacctgctgttctcgttcatactcttccgcacttttaaaacgctttgaaatggtcagtgttaaaaagagaagattaatggtcattatcgctcaccccctttcaatatccgcacaagcgaaaataacccgcagcaaacttcatatgcgctgcgggcagactaaatccgcagacaaaagaagacggagcttctttccctgcggggagctgcgaatgtcctgatactccgaaattaacgtgcttgacgggcagaggttaaggaaggacacgaactcttccacaggctgaatcggttcaattgtaaattttgattgccgtttaacgtcgtcatgtgattcaacctccctttgcttttttcttactttgtaagtatatccatcagcttccattttgtaaacatttttttcaagatttggacggaaaatgtgctggcattccgcttcaattgtccgtgttttccggcatctttcttacctcaggaaactcttttcatcccttgctttttctgatctttttttgaatatgcaataaaataaataaggccgacaaacactgccccgccgattacattcccgataaaggccggaatgagattgccaatcagatcaccccacgaaaaagaacctgcaaaaatcgcagccgggatgataaacatattggctacaacgtgctgaaaaccaattgcgacaaacgccataatcggaaaccatatacccgcgatttttccggctccgtcttctgcgccgaaagaaagccagacggccaaacagacaagccagttacagccgatcgccgaaacaatgacttttccaaacggcatatccaatttgccttgtgcgaccgcaatcgttttttccaagtaaggtcctgtttcggttaatccgacaacatgtccgaaaaagtaagcgacaaacagtgcgccgacaagattcatcaacgtcacgatcacccaatttttcactaatgcaccggcggatattcttctggaaaacagcgccatagataccgacatcatatttcccgtaatcagctccgcgccggcaagaacgacgagcaccaatccgatgggaaacacggacgccccgattaaactcgacaggcttccccattctttcggaaggtcgccgatgacacggatatcaagcaaataaccgagtgcgataaacgctcctcccaaaaatcctaatacaatcagtgctgaaagcggtgaatgcaccttttttacccctgattcgaccgcaagctccgctatttcgtccggtttacgaaaagccataataacccctccatttatcatttcagcccgcagtttccaaaggcgcctaacaaaaaaggcagcattcaaacagcccgtctaaaacgggtttgaatgctgcctaacttgtatgcatacccatacaacaatatcaagcagaatgaaaatattagctatagaaaatgtacagatcatgcacacattccataaaaaaatcgtccttaagccactgctggcagttcatatcatatcaaatgtgacaatttcgtgtcaattgaatttttttcagcttttgatttcttcacggcgctcttcaatggttcggtcaaagacaaatacagacaccgcaatattctcttcgatcttgatgtctgaaaacagatgcacgagctttgctccgatgagctcttccattccgtcaggcgtttgttttgaatacagttcctgaattaagctggtccgcgccgcatgaaccatttctcttccttcaggcgtgcgtgcgataaactgctcacttgcgcttagattgccgtaaagcgttgataccgccatgttatccacaaaaacggtgtgaattcgttccggcccctttccaaataattctttgcgcaatttccggataatatcgttaaattcatgaatttttttagacatattgtccctccgatttcagcctatgaaagacattcccggttcccctttttgacatttcacctggttaaagttttcctttcgtattgtattataataaatatcaccttataataaaagcagtgaagatggatttgtaataggaaacgtgttacgagtctatcgttttatacaaataggattggtctgttagtaagacttgctagtgaactattccgccatgcgtatttataccgttctccggacaggaggccggtatctatgtgcatggctttttttcgagtttaaaagatggaggggaattggaagtgacagacgttcagtctatccgtgtcaaaattgacggcacggagtatgaagcaccagaggggtcaaagattttagatattttaaaccaaaacggaattgagattccgcaaatatgccatgtaccggaagtagatccgattcaaacatgtgacacctgtattgttgaagtaaacgggaaattgcagcgctcttgttccacggctgcagaaaacgggatgtccatctcgcttacgtcgggaagggtaaaagaggctcagacagaggccatggaccgcctgctcgagaatcacctgctttactgtacggtatgcgataacaacaacggcaactgcacactgcataatacagcggaaatgatgggaattgagcatcagaaatacccgtatacgccgaaagatgattcaaagtgcgcggttgatatgtctcacccgttttaccgctatgatccgaaccaatgcatcgcctgcggccaatgtgtggaagtgtgtcaaaaccttcaggtgaatgagaccctttcaattgattgggagcgcgaccgcccgcgggtcatttgggatgaaggcgtcgccattaatgaatcatcctgcgtcagctgcggccaatgtgtcactgtctgcccttgtaacgcactgatggaaaaatcaatgctcggccaagccggatttatgacaggaataaaagaagatgtcatggaaccgatgattgatttagtgaaaaatgttgaacccgactatacaagcatcttcgccgtgtcagaagtggaagcggctatgcgcgataaacggacgaaaaaaacaaaaacagtctgcacgttctgcggcgtcggatgctcttttgaagtatggacaaaaggccgtgacatccttaaaattcagcctgtttccgatgctccggttaacgcgatttccacttgtgtgaaagggaaattcggctgggacttcgtgaattcggaagaacggattacaaaaccgcttatccggaaaaacggcgcatttgttgaatcgtcatgggaagaagctcttgaccttgtcgcttcaagactcggttcgatcaaggccgaacacggaaatggttctgtcggttttatttcttcttctaaaattacgaatgaagacaactacgttattcaaaaattagcgcgtcaagtatttgaaaccaacaacgtggataactgttcacgctactgccagtcaccggcaacggacggcttattccgcacagtcggtatgggcggcgacgccggcacaattaaagatatcgcaaaagcgggcctcgtgctcatcgtcggcgccaatccggcagaaggacatccggttctggccacacgcgtgaaacgcgcccataagctgcacggacaaaaattaattgttgccgatctgcgcagaaatgaaatggctgaacggtccgacctctttatcagcccgaaacaagggactgaccaagtctggctcatggcagtgacaaaatatatgattgaccaaggctggcacgatcaagcgtttattgatgagaatgtcaactactttgaagattataaagaaacgctgaaaaagtatacattagaatatgcggagcgcatcaccggactttctcaggatacaatcatccgcattgccgaaatgattcgtgatgcagacggcacttgtgttctttggggcatgggcgttacccagaatacaggcggctctgatacatcagcggcgatttccaatctgctgcttgccacaggaaactaccgccgtccgggcgccggagcctatccgctgcggggacataacaacgttcaaggcgcttgcgatatgggaactcttccaggctggcttccggggtatcagcatattaccgatgatgcggcacgcgctaaattcgaaaaagcttacggtgttgaaattgacggcaagccgggtcttgataatatcgaaatgctccatgcgattgaagaaggaaacatgaaagccatgtatcttgtcggtgaagatatggcgctcgtcgattcaaacgccaaccatgttcatgacattttatccagccttgatttctttgttgtgcaggatattttcctttcaagaacggcgcaatacgcggatgtcatcctgcctgcagttccatctcttgaaaaagacggaacatttacaaacacagagcggcgtgtgcaaagattgtatcaggcgcttccgacgcttggtgatgctaaaccggactggtggattattcaggaagtcgccaatcgtttaggcgctgattggaattacacgcatccaagcgatattttctcagaaatggcgagcctttctccgctgttcggaaaagcaagctacgacgttcttagcggctggaacagcttcctgtggggaagctttacgggagagagcactccgcttctttatgaagacggctttaacttcccggacaaaaaagcccgttttgcgctgagcgattgggtggagcctgccgtattccctgaagaatatgacctgcatattaacaacggacggatgcttgaacatttccacgaaggaaacatgacaaacaaatcgaagggcattcagtctaaagtgccggatgtatttgttgaagtatcgccggagctcgcggctgaacgcggaatttgcgacggaacaatgatccggctcgtctctccttttggggcggttaaattgaatgcgcttgtgacagaccgtgtccgcgcaaatgagctttatctgccgatgaactctacagataaagattctgcgattaatttcctgaccgggcctgcgtatgattcacggacacatacacctgcctataaacagacaaaagtccgcatggaagtgctcggctcctgtgatacaccgccgcttccgaaaacgaatccgcggaacaaaaaacgtcatccgcaaaacagtgtggaagctcagcgaaaatggaaccgtccgggctatgtgcacctaactgattaaggaaaggaggaaacattatggcaagcccaattactgaaattcaaaaagaaacgaaaacagaggaacagctgaaagctgaaaaactggaagaactgaagacgcttctcgcagaaaatgaagaagccgtcgcgaaaacgatgtccattatggcagagctgaatggcttgggcatttttgatgccgccggctatatgctccaggcaaaagaggagattgccaaaatcgcactcggacagatttcccgggaacctgtcaccaatcttctgaatacgatgatggccgcgggaggcgcgctgtcaaaagctgatcccgaatttatgggcagacttttagaaagcgccatggccgggacggatcaggcgcaaagatttttaaaggaggacaggaaagtcagtatgtttgaactgatgaaagccgtcggtgatcctgatattaaccgcgcgctcggcttcgggcttcagtttttaaaaggaatgggaaaagaattacgcgaaaccccgtctgaataagaaatgaaaaagccattgtcaaaagacaatggctttttttattcatcggcctcttccagcctctttttataaataagtgaacggtcaacgcagaaataagcacccgctaaaaatgcacaatccgttacaaacatcagcattttctggcccgcagtcagcccttgtccgggaagaaccgcgccgatataaatgaaggtgctgactgcaagcagaataaatgcgtaatgcttaaaatcttctattaatgatttcagtcttttcttctccatataaggtcacctgccagttttatagtctaccaacattataatacaagctgacagccgacagagaatgtaaatctatccattctttataaaagggaatcaagcgcctgtttcacatccgccgttaaatcctcagtatcctcaataccgattgagatccgtacgagcccgtcggtaatgccaagcgcaagccggcggtcgcgcgggatcgaagcgtgcgtcattctggacggcacggagattaagctttcaaccgctcctaagctttcagcgattgtaaacaggttcaatttttctaaaaatgcgtcgacgcgttcactgctgccgatatcaaaggaaatcattccgccgaaaccggagctttgcgcttttgtcagctcatggcccggatgtttcgctgatcccggatagtagagcgtctgaacggcatcatgcgcttcaagcagctcggcgattttcccggcgctgtgattgatggcatccattctgagtcccagtgttttaatgcctctcattaaaagccatgaatcctgcggtcctaaaacgccgcccgttgagttttgcacgtaatgaagcttttcaccgagctctttatcagccgtcacaactaagccgccgacgacatcgctgtggccgccgagatattttgttgcgctgtgaagcacgatgtccgcgccgaagctgagcggctgctggaaatacggcgtgtaaaacgtattatcgacgataagcaatacgcccgcttcttttgcgatgtcagacatcagtttgaggtcagtcactttcaatagcgggtttgtcggtgtttcgatataaatggctttcgtattcgggcgaatggcctttttgactttttcttcactgctcgtatcaacaaagtccgcttcaatgccgaagcggttcagcacacctgtcatcacccggtaagtgccgccgtatacatcatccgtcaaaataacatgatcgccgctgtcaaacagcatcatcacggcagtaatcgcagccatgcctgagccgaacgcatatcccgccgcgccgccttcaagctccgcaattaagctttcaagcgccgtccgcgtcggattggccgttcttgaatattcataacccgtgtgctcgcccgctttcggctgccggtacgtgcttacttgataaatcggtacggaaaccgctcctgttttttcatctcccgtaattcctccgtgcaccatcagcgtttttttcttcatcttactgacctccttgaaaaatgtttttgcttatatatcgatcgctgccgtcagggaaaatagtgacgatatttgatccggcgggcgcttttttcgcttcttcaagcgctgcataaagagccgcccctgaagagcttccgattaagaggccttctttctcggccgcttctctgacaagcgaaaacgccgtatcgtcttccactgtgtaaatggcgtcaaaatggttctcgtccatatattccgggataaactccatgccgatgccttccgttttatgggcatgcggctctcctccgttcaggatcgagccttccggttcaacgatcaccgttttgacggcaggatttttctcttttaaataagctgccgtaccggcaaaggtgccgccggaacccgctcctgcgacaaaggtgtggatatccccgccgagcgcgttccatatttcaggtccgatcgttttatagtaagtcaatggatttactcggtttttaaattgcagaacggcataagaattattaatctctctctccagttcaagcgcttttcgaatggctccctgcatgccttcttctctcggggtatgcacgatgtccgctccgagagcttccataatttgctgcttttctctgctgaaatgctccgggacgcaaaaaacggcgcgaagctgatgctttctggcgcacagagcgagtccgatcccggtgtttccggcagtcgcttcgatgataacaccgcccggtttcacctttcccgtgcgaagcgcatcttcaatgagcattccgcccagcctgtctttaatgcttccgcccggattcatcatctcaagtttagcataaaccgctgttccctccggtatatcaaaatgcttgagacggagcagcggtgtatttccgatcagttctgtaatatctgttatcacgttcaatatgtgtcctcctcctggaaaagcggaggagaacgagaatcccccgcttagtgaattcgtttgatgacattcaggacaagctcagttgaatgagcggcagcctgttctaaaaatttatcaaatgaaacgtcagattcttttccggcaatatcagataaagctctgatgacaacaaaaggcgttttgaactggtggcacacctgtgcgacagccgcagcttccatttcaaccgcgtacaaatctgcaaatttggcgcgtacgtcttcaacccgcttcggatcattcataaaagaatctcccgtagcgattgtgcctttggcgacttgaatgccgttcagttcagaaaccgcttcctcagtaatactgatcagcttttcatcagctttgtatgctgccggaagacccggcacctgtccgtattcatagtcaaacgccgtcacatccacgtcatgatggcggacatctgttgagatgacgacgtcgcctacattcaatgtatgatgaaaaccgcccgctgagcctgtgttaatcacataatcaggtttgaaacggtcaagcagaagcgtcgtgctgatcgcggcgttgacttttccgatccccgatttcagcaagataacttcgacgccttcatagctgcccgtcgtaaactcacagtgagcgatcatctcttgttttgcgtctttcagtttgcttcttaaaatcgtaacttcctcttccattgctccgatgactgccagtttcatttatacacaatcccttcgatttaccgtttaatcgcctccattatccagacaaagtcattttgctgcgtaaaccgcgcggcaaatccctcttctgaaaagatgtttttcattgtcccgagtgtcggataatgttccgtctttaaatcgtccgctaattgatgatagccgtttcggattgcttttttaattgtttcatcataagcttcatgatctttaaagacggtatcggcaaacactattttatcatgcttctgaaggattgtgccatattgctttacagccgcttgcttttcttcatctgttaaatgatgaaaggcgtacgagctgacgatggtatctatttgaaaaggcggagcgggaaactccagaaaatctccgtcactgaacacggctttgtcagaaagcttgtcagccgccagttttctcattgacggagacggttctacaccaaacacctttttgttcgcggcggctaatttcgccgttaaattccctgtgcccggtccgaactctaaaacgtttgaacctgaaagtgcgacgatgctgtcaagaatattgtcataccctttaaaaacatcagcatattgtttgtctgccccgtgcactgtggcatcataagtcgctgcccaatcttcaaataatggaataaattcacggcccatatttttcactctccataatttataattcctatgagtatagtatggattaatcgtggaacagttcctatcctatcacaaaaaagaatggaagggtactaaaatactttgggattattgcgcaattacggcagaaaggcttatactttcattgactcagaagaaaaatcaggaggatctgtactgatgaattttcaattggatttaatcaaagataaagtagaatttttcgaagcggcatctttgcaggagcttgaaaagaaaataaacgttcagattgaaaacaaccaggcgattatgcttcgcgtccgttctgtatcccatcaggtgacggccgttgacggcagaatcctttacagcgcgtcggtgcatttttcagctgacgtatgacagaaaaaagcagctgaataatcagctgcttttttgcggttattttaacgtttctacttttgtcggcttccagccttttttgtctttccaagtgatggtgacctgatactttttgccgttcgttttgtctaaaactttacccttcgcatcttgcgggcttccattgtttccgagccacagcactgtcatgtgatcttttgacacgcctgttgcgtaagagatggcgtcaagcatttcggaccagtcttcagagcttgagtcatacgtcgccgcatgttctcccgtctgctttgttccgaccgctttccattttgggttaacaattgttttctcgacatcgcttgatgagccgccctctgttatttttgctcctttaaaaggatcgcttgaatcagagtcttttttgctgctgtcatcacttttcgatgaatcatcgtcttttttgctgtcagagtctgaagatgaatcagatgtgtccttatcctgtttatcttttttgtcatcgtctgatgccttatcttttttgctgtcttttatgtcttcatcggatgtctgcttcgtcttgcctgatgcaggtgtttcctgcttctggctcgtgtccgctttttcgctcacgtcgctcgacggactgttgatgaagaggctgactgcaacgacgacaataagaatagatacgatagcaattaaaatgttaagcaccatatttgcttttctgcgcttatcacggttttcaaaacgagattgtttattgctcaatcattctgcactcctttatccctcttgctcagcatatattttaacatgggctgagcggttgttctatgtctgatttgtttcattttcatgtacctttttaacaatatcataaaacactgtatttgtcagagccttatcccccggcgtgtccatgtgcagcaccacgagagcgtatttcggcttgtccgcgggaaagtatcccgcaaaccatttgtggtaaagcgtctgtttttcttttgtgaacattcccgtctgggccgttcccgatttgcctgctatctcatacggcagatcctgaaaccttcggccggttcctttcggtgaggtgacgacttctctgagaattttttgaagctgctgcgccgtatatttgtcgatgttttccccttttaacggctgatctttgaatgacgccatcgtcgttttgtttttgtattcaattttgtccgcgattttgacttgttttttttcaccgccgcgcgcgatcgccgccatcatattggcgacttcaagaggcgtgactttcacgtttttttgcccgatcgccgtctgtgcgacggctttttttacggttttgtctttgtcatctccccaaatgaccccgcttttttcattatacagctgcctgaatccgtcttcccggtacagcttgccttcccagcccgcccgctgtgtgagacctagtttttccgccatgttttcaataacggaatcatcttttttgatcaatttttccgcaagacttgtaaacgtataattgcagctttgggcaaagctttctccaaaactgagcgtgcctttgtcatcccccggctctccgtacaggttgagattgcagttaaaggatgtgcccggcttcacttcgttttgttctattgcggctgcggcaatcaccgttttaaacactgatcccggataaatcggcgtcagcatgtaattttgcagtgtctgctgctttgacatgtcagcgtcaggctttgataccattccgagcacactgcttttttcaatgtctaaaaggacggctcccccttttttaacccgcggtctttcaatacatcttccattgcttcttgaatattgcggtcgatggaggttttgacttgcagcggataaaacgcgtttgcttcagccgtatatttgacgtccattccgaataaagggtttccccttccgtcgacatgatacaaaagttttgtgtcctgatccgccagtaaaaactcatcaaacgtccgctccatcccgcttgtcccgatttttgccgtgatcggcagttccttcctcccggggtatttctttttcaaaagctcagggtcctggtttgtcgcgcccaacagatgagcggctatgtttgtttctttgctgtctttcatatatacgccgtaaatgccgggatatttcaaagaattgatatttgccacggattgtttcgtcaaatgttttatttttctgctgttcaggatcaccggtttttttgcttccgtgagcagctgcctgagctccccctgtttcattccgagaatgtctgatacccggtcaaccggccaatcctgcgtcacgagaaagggaaacagtatgacggcaggctgcttttttccggtcagctctttgccgttccgatcaagaaaagagccgcgtccgtctgaaataaggacttcttccgtccgctgcttgacgctttcctgaatcagattaatattggattttgaaaaagattctgtaaaaaacagctgaatttcagccagcctagcaagcagaaagaaaaacacgagcagaaaacaaatcacggccgttttcagcctttttgatacgatcataaaaaacacctcatccacattttggacgaggtgtttcattgttaaacggatcttatgaaattttcacaattttcacgagcatttctccgcccggcgtctgaactgtcacttcttcgtccacttttctgccgagcaggctttttgcgattggcgagtcgtttgagatttttccttcaaacggatcagcttcagcgcttccgacaatcgtgtaagattcttcttcaccgtcgggcaattcgatgaatgatacggtttttcccaaaccgactacatttgaaccgccgtcatcctcgatgattttcgcattgcggatcatgttttcaagcgtcgtgatgcgcccttccacaaatgcctgttcttcttttgcggaatcatactcagagttctctgacagatctccgaagcttcttgcgattttaatgcgttctactacttctttacgtttaaccgttttcaattgctctaattcttgttcaagtttttgttttccttcgtgagtcatcggaaaaactttttcttgtgccatgttccttcactccttggtggttgtccctcaacaataacgtgtgattatgtatgagagcataaacgaaaaaatcaagaatgagaacacagggcagtcctcgttcttctctcccatataggtactgtttatcttaaactgaatgtgtgttttctgcaaatgtttcggtttataaacagggaaagaagggaactgtctcattcccttccagcctatacataatatggtctgagttatttatgtctatgctatggtattacaaaattgcattttgttcaaggatcgtttgaatcttcgtgaccatcagatcaattgcgacgtggttttgtccgccttccggaataatgatgtccgcgtagcgtttcgtcggttcaacaaactgattgtgcatcggtctgacgacggacacatactgctcaatgacagaatcgattgaacggcctctttcgttaatatctctcataatccgtctgatgatacggagatccgcgtccgtgtcgacataaagtttcatatccatgaggtcgcgaagtcttttatcttcgaggacgagaatgccttccagaataatgacatccttcggctcaaccggaatggtttcctcagaacgcgtatgcagtttataatcataaatcggcttttctatcggccggtaattcaaaagctcttgaatatgctcgattaaatagtcattatcaaatgcgagcgggtgatcatagtttgtgttcagcctttcttcaaacggaagatggctttggtctttataataaaggtcttgctggatcattaaaatcgagtgtcctttaaactgttcatagatggaacgggtgacgcttgtttttcctgatccggaccctcctgcgatgcctataactacaggactcttacccattggtgattacttcccctttctcatcatgttgctcggataaatctttttgtctactttaaatgtaacgatttgcaggggatggcgggcagcatcaagctcgtttccgtcttcgtcccaaatagtgccgattgtgaatgtgaaattgtcgatttcaggaccgaaaaattccacttcgtcaccttgtttaaagaaattgcgctgctggagcgtcaccatttgagtttcctcgttatacgcgagcacgagaccggcaaaatcaaatgttgttttctttccgtgttcgccgaacatctgctcttcatacccgggcgtgccttcaaagaaagcaggcgcggtatcccggtttgcacatttgtccagctcatccagccattctttttgaatgacaaagttttcaggatcagcgcagtatgcgtcgatgactttgcgatacacgctgacaaccgtcgcaacgtaatgaattgatttcatccggccttcaattttcagactgtcgatacccatctcgatcatttgcggaatggattcaatcaattttaaatctttcgggctcatcgcaaacggagcgtcttcttcgtcatagagcgcgaccgcgtttgcaccgtctgtctgatacagatcataatcccagcggcaggactgacagcagccgccgcggttggaatcccgggccgtcatgtgattgctcagcacgcatcgtcctgaataagcgatacacatagcgccgtggataaaggtttcgatttcaatatccaccttttccttcatttctttaatttccagtccgctcgtttcacgggcaagcaccacgcggtcaagcccttcttctttccagaactgcaccgctttccagtttgaaagggactgctgtgtgctgaggtgaatttctacgtccggggccactctccggcatgtttcaataatcagcggatcagcgacgataattccggcaacttttgcgtctcccaacgcttttaagtattcttccagaccgtccatattttcattatgggcgaaaatgtttgttgtcacatatatttttgccccgtattttttggcaaattctacgccctctgcgatttcttctattgagaagttatccgcatttgagcggagtccgtattcctgtcctccgataaaaaccgcgtccgctccgtaatgaacagcaatttttaatttttcaaggtttcctgccggagcaaggagttcaggttttttcgtaatgacgcgttttccgtttacgactttggaaatggtttgatttacggctgtcatccgttgcaccctcctttttaatagaccgtttctttaaagaagaatcctgtgtcgatgcttctgttcacaggctgaatgctttcaatccgctctatccagctctcttttttctcttcgtatgtctctcggctttcaaagcacagattgattgcttctctgtacatgcgggtcacttcagttaagtattcaggagacttcaaaactccgtcaattttgaaagaatcgatgccggcgtccatcaggtcctctaattcatcaatcatgcacacatcgttcgggctcatgatgtgcgtgccgttttcatcttcaaaaatcgggtatttattgccccgttccttgtcatgcagaaacattcccgcttcttttttcttctgttcgatgtccatgacttttccctggtattcgaagtaatggcccactaaagaacgcttcgattggaacatgcacgtcatgccgtggatttgaatttcaatttccacttcggcgttttcttttatgtcaatgatgctgtccatatttaattctttagccagcactgcccgccgtgcgcctttgcgtccccagtaattgcaggaatagtagttggtacccgttgtttccgtgctccagtgcagtttgagatcgggagccgcttcacgcgccgccattaaaacggccggatcaccgaaaacagcagcatcaacgccggcctcctgcaaaaaggcaagatagccgttcagctcgtccactttttcgttgtgaaaaatagcattgacggcggcgtacactttcgcgccttcctgatgagctgtctttacggcttcttttatatcttctcttgaaaattccccggccagtctcaggccgtatctctgttctccgactaacagggccgttgcgcccgcttgaatgagcggaagaatatcctgtacagaagtcggagtcaccaaaagttcaggttttttcatgatcattcacctcttctttttactgatggcgatgccgtctccgaccggaagtatgaccgtttgatagtcaggccggttcatcagccattggttatattgatcaattttttcaacaagcttccgtcttcttttcggctcaatgtccgagtgattttgtgccaccagtcctttaaacagaacattgtccgtaaaaatgactccatccggcgcaagcatcggttcatagagctcaaaaaagttcgtgtactggcctttggccgcgtcgataaaaatggcatcataaggagccgtgacacggacagactcagaaagttccagcgcatccccgtgcattacgtgaatccgtttttccatttcaaagtcttttatattgttcacagcttcttcatagcgtttgtcgtcccgttcaatcgtgtaaatattcgcatccggaagctcaagcgccatccgtatggcggaatatccgattgccgcgccgatttccaaaatgtttttcgcctgttgaatcgacagcatttgaagcagcacttcaatgcccgcttcttccataatcggaacatggtgctcttttgcataggcttcaagctttttcactttatcaggccgaggcttcagcatcgcgtttatatactcgtttatttgttcataccgatcattcacggcaaacagcctccgttctaaaaaggagtgcccctgacgaatccgcggggacactctcttaagacacttctttatccataagtaaacaacccgatatattttatcataaaacctttcagaatggaataaaaggagagcttttgccctccttttattcgctgtcttttttggaaatatacttttccttcgctttattatggtcttttaatgttttggtgaaaacgacctcgccgtttgattttgcaaggaaatagagataatccgttttgtcagggcggagagccgcttcccatgatgaatcgccggcatttgcaatcggtcccggcggcagccccttatgtttatacgtattaaacggagaatcaattttcaggtctttgtagtagacccggcttttatgcctgccggccgcatataataccgtcgggtcagtctgcagcggcattttttctgcaagcctgttgtaaaaaacgctggcgattttgtgacggtcggctttggcggtggcttcttcttcaataagcgatgccatcgtcagagcgttatggacggaaagtttctttttttccagttcagatttatacgtttcgatacgggtgtttgtttcctgaaccattgccgtcaaaatcgtgtcaagcgatgcatccggatcattaaacggatatgtggccggatacagatagccttcgagcggatgcttgagcttcttgtttgaaagtgcgtccgttatcgtatcaggaaactgttttttcagtttgccgatgaatgttttgtcatccagtttcgccataatctcttcttttgaatatgatgtttcttttgcgatcgcatccgcaatctgtgtaagctgttttccttcaggaacggagatctgaaaggcatatcccgttgatcccgcggtcagttttttgataatcgcatccgcatccattcctttattcaggtggtaaaatcccgcctgaaacccggaagcgcctttatacttcacatacagctgaaatgcttttttgcttttgatgacatgctgatcctcaagaatttcagcgattgccgaaacggaagaaccgctcggaatattaatattgactgccgttttgctgcctttgtcaaccggagacagcagagattttccatagaaaaaagcaccgcaaatgatgataagcagagcaatcacggaggacagtattatcgttgtttttttgtttttacgcggaaatgaatttttagtctgattgatattcatacaagtattttcctcccaacagctcttatactacatgattcatgtgcattcggcaatttattacaaaaaaaagccgaagcgcatatgcgctccggctttttctgttcattttattcttcgtcttcttccgctaaaaacgtgttcagcgtttcttcgatcatttcccactcttcatcggtttcaatcggcatcagttcgccgtcttcaccgttttcgttcggttcgaagcttgaagcgtgaatttcgatttcatcatcgtcttgagcatcaatcggataataaagtacgtaagatttgttgaatgtgtcgttttcaaatgtgaacagcacttcgcaaagctgttcgttgccttgatcatcgacaattgtaatgtgtttttcgccgtgttccatttctttcacctcttagtttaaactgtccagatatccttgaaggatcatgacagccgccattttatcaatgactttttttcgtttttgcctgctgacgtcagccgcgatcagcattttttcagccgccatcgtcgtcagacgctcgtcccacagcacaacagggacattgtacgctgtttcaagcagtttcgcaaatgtttggctggcttcgcctctcggaccgatcgtcccgttcatgtttttcggaaaaccgagcacgatcttctctacattatagtctttcatcagctcggataaacggtccagaccgtaatctccttcagcctcgtttatttttatcgtctcaatgccttgagcggtccagcccatttcatcgcttaaagctacgccgagtgttttcgtaccaagatcaagtcccaatattctcatgaatgtatttacgcctctttatgctgttctagataggattttaccaattcctcgattaattcgtcacgttccagtttgcgaattaagttccgggcgtcgcgatgcctaggaatgtatgcaggatctccagacagcaagtatccgacaatctggttgataggattgtaccccttttcctgaagcgcatcatataccgtattcagcacttcttcgacgtttgtttcagcagaatcatcggagaaattaaatttcatcgttttatcaaacgagctcaccgttttgcacctctttcccaaattcgcaggcaaagttcagcctgaggtcctcatcttatcatcattctacactagttgaaaggattataaaacggattttatccaatcttccgcagatgcgagcgcctcttccaatttttcaggctgctttccgccggcctgcgccatgtccggacggcctccgcctccgcctccgcagacttcagccgcttgtttgaccattttgccggcgtgaaggcctttttcgatcaggtctttcgtcacgcctgctgaaaggttgactttctcgttttgcacggcgccgagaatgatgaccgcagaaccgagcttcgctttcagatcatccaccatagtgcgaaggtggttcatgtctttcgcatttactttttcagccagcacttttacgccgccgatgtcttttactttagacagaatggctccggcttccacattgccaagtttgctgagcaatgattcattttctctttgcgcttccttcagctctgcttgaagagactgaattcgcttcggtacgtcttttacgtttgatttcagctcgtccgcagcgtgctgcagaaggctgagctggctgttcatttcctgataagcgccttttcctgttacggcttcgattcttcgcgtacctgcgccgatccctgattcggatacgattttaaacagaccgatttcagccgtattcgtgacatggcatccgccgcaaagctcaaggctgtaatctccgacttgtacgacgcggacgatatcgccgtatttctcgccgaacagggccatcgcgcccatttctttcgcttcattgatcggtttcaaatcaatcgctaccggaatgctctcccagattttttcgttgacgattccttcaatgcgttcaagttcttcttttgtcacttgaccgaaatgagagaagtcaaaacgcagacgattttcggtaacgagtgaacccgcttggttgacatgtgtgccgagaacgtctttcagcgcctggtgcagaaggtgggttgctgtatggtttttcaccacgccgcttctcatttgatcttcaacttcagccgtcacgcttgcgcctttttgaatcgtgccgctatccaccgtgccttcgtgtacatgctgaccgttcggagcttttttcacgtccttaatggttacgacagcctgctcgcttctcagcactcctctgtcaccgatctgtccgccgctttcagcatagaaaggcgttttatcaagaagaatttggacggtatccccttcatgcgcctcgctgattaattgcccgtcatgaagaagctcgatcaccttcgcttcagcttttacggcactgtagccgacaaatgtgctttctgcggtaatgtcgcgcaatgcgccgccctgcacctgcatgcttcctacatcttggcgcgcatttctcgcccgttcacgctgtttttccatttcggcttcaaagcctttatggtcaaccttcatttgctcatcttccgcgtattcctccgtcaattcaaccgggaatccgtacgtatcgtacagtttgaatacgtcttttccggagatgatgccgctgcctttttccttctctttctttatcacgtcggataaaatggccagaccttcgtttaatgtttcatggaagcgctcttcctccgttttgatgactttggcgataaactcttgcttttctttcacctccggatagaaagcgtccataattcctgcaacagtcggaaccagctcgtacataaacggacggctgataccgatggttttcgcgtatcgcaccgcccggcgcaagaggcgtctcagtacatacccgcgcccttcatttgacggcagagctccgtcgcttaccgcaaatgcgaccgttctgatatgatcggcgatcactttaaaggccgtatccttcactgcatcctttccgtaagtatctccggaaatacgctctgttgcttcaataatcggcataaacaaatcagtgtcaaagtttgtcgggacgtcctgaatcacggagaccatccgttcaagccccatgcccgtatcaatgtttttcttcggaagcggtgtgtacgtgccgtccgggttgtggttgaactctgagaataccaggttccacacttcaagatagcggtcattttcgccgcccggatacaattcagaatctgacggatcattgccgtatttctcgccgcggtcatagaaaatttctgtattcggtccgctcgggccttcgccgatatcccagaagttcccttccagacggatgattctttcttccggaacgccgattttttccgcccatagcgtataagcttcttcatcctcagggtgaaccgttacagacagcagctccggatcaaagccgatccacttttcgctcgttaaaaactcccatgcccacgtgatggcttcttctttaaaataatcaccgatggaaaagtttccgagcatctcaaagaacgtgtggtggcgcgccgttttccccacattttcaatatcatttgtgcggattgatttttgcgcgtttacaattctcggattctccggcacaacgcggccgtcaaagtattttttcagcgtcgcaacgccgctgttgatccataataaagacggatcttcatgcggaaccaatgaggcgctcggttcaacggcatggcctttttctttaaagaaatctaaaaacatttgacgcacttcagcagaagttaagtgtttcatctatattcctccttatcactacccgaaattctcttttgcgacagcaaaaaagctctctccctatgcaaaccatgcgttcacacagggacgagagctgtctcgcggtaccaccctgattacaggccgaaaaaggcctgtcacctttcatcccgtaacgcaggattgcggcagcctttaactgcactcaggattagcttcggccgatcttctgctgaagctcctttcagcgtatcggagcttctctcttaaacagggcttcggcgtactcatatccgtcactcgagattcgtatgtattctactcgaaattatagacaagcagaacccgaatgtcaatgttccgtcctgatccgcaaaaagtgaatggccgtcacttttaaaacggctgccgccggaacagcgagaatcatgccgggaatgcccgcgagctcccctccggcaagaagcgcaagcatgatcacgacggggtgcatcctgagacttcgtccgacaatgagcgggctcaaaatgtttccttctataaattgaagaataaaaatcgtgacgattacgatgatcacagccttggaggaaatcgccagcgaaaggagcagcgccggcacagcgccgataaacggaccgaaatacgggatgacattcgtaatcccgatggcaaggcccaaaatcagcgggtaaggaagcccgaacagccaaaatgaaacgccggctatgaacccgagcaaaaaacaaacgagaagctgaccgcggatgtaatcaccgagagagtcgtccacatcccgcagaaattcactccccctttttctccaggatttcggcgtcaaataccagaccgtctttttcataacgtctatatccttcaccatatagaacacgagaaaaggaatcgtcgccgcgatcaggatataatcaagcacgaaacggatgcttctgatcgtgctttcaatcgtgccggcaagaaacgtttctgtctgctgaatcattttgtccatccgatggtgcatgccgtcaggccaatgatccgtgtgattatgcagatgcctcagcatgctgttgtagttttcggccagaccgggaatgctctcagacagatcctgcagctgttcaattaaaacaggaacccctttataaaccccccagccgattccgccgaaaaacaggcaataaatcagaagcaggcttaaagttctaggcatcccttttctatgaagccattcagtaatcggaagtaaaagataagcaataaatactgcgatgaatataggaataaagagagattttataacaagccaaatgggagaccataacatatcgagcatgcaaaagacatacactgttaacaaaacgagcagacatacagccgtccacattaagagctgcagcggtttttgaagcatgacgtttcacctcttgctttatcttttgacagaaagccggaattattcccgtttcataaactccgccttatgacgcagacctcttgatggaaataattatcagaaattacgaaatagtctaactaatattcataaaagtctgtataaccatcgtaatgtgttaagggatttcaaaactgtccagtcaatatgactcatgtttttttaaggaggatggccatgatttcatttcaggatgtaaataagcactacggacatttccacgtgctgaaaaacattaatctgcacattaaaaaaggggaagtcgtcgttatcatcggaccttcaggatcgggaaaaagcacgcttctccgctgcattaatcagctggaaacagttgatggaggcgccttaacggtaaacggcgtctccatccgtgacaagaaaacggatatcaatcaggtccgccggaatatcggaatggtgtttcagcattttcatctgtacccgcacaaaaccgttctgcaaaacatcatgctcgcaccgatcaaagtgctcaagcaatcaaaagaagaagcaaaggaaacggccttatactatttgaaaaaagtcggtataccggacaaagcggacgcttatccttcacagctttccggcggccagcagcagcgtgtcgccatcgccagggggcttgcgatgaagcccgaaattatgctgtttgatgaacccacatccgcgcttgatccggaaatgatcggggaagtgctggatgtcatgaaaacactcgcaaaggaaggcatgaccatggcagtcgtcacacatgaaatgggattcgcaaaagaagtggcggaccgcatcgtgtttatcgacggcggatccatcttagaagaagctgcaccggctgaattttacgaaagcccccgtgaagagagggcgcgtttattcttaagccgtattttaaatcactgaaaagaaacggaggagcgcttatgtcacgcgtaacaaaatggttgtcattcggattgatatcactgctggccgtctttatgctggcagcctgcggagggaaagaaacgtccggggattcaaaaggaacgggaaaagacacgttagcctctattaaagacagagacaaaatcatcttcggcgtcaaaaccgacacgaggttattcgggctgaaaaacccaagctccggtgatattgaaggcttcgatattgatatctcaaaacagctcgcaaaagatattctgggggatgagaagaaagcggaatttaaagaagtgacgtcaaaaacgagaattccgatgctgcaaaacggcgatatcgacgccatcaccgccacgatgacgataacggatgagcggaaaaaagaagttgatttctcagatgtttattttgaagccgggcaatccctgctcgtcaaaaaaggaagcagcatcaaaagcaccgaagacctgggaaaaggctcaaaagtattagcggtaaaaggctccacttcctcacagaacatcagagaaaaagcgcctgacgcctcagtgctggaatttgaaaattacgccgaagcgttcactgcgcttaaagcgggacagggagatgcgctcacaaccgataatgcgattttatacggcatggcggatgaaaataaacaatatcagctgacgggcgaaaccttcaccgatgaaccttacggaatcgccgtcaaaaaaggccaatccggccttgtcaaaaaaatcaacgcctctttgaaaaaaatgaaagccgacggcaggtacgaaaaaatctataaaaaatggataaaagaagaaccggcaaaataggacggaccgcgggatgagcaggcatgctcatccccgttttataaggagtgacatagatgaacttttcaattttaacggaaaacttcgatatgaatatggacggtttcctgcacacattgcttgcgagcttcatcgcgctggcaggcagctttgcggtgggcgttctgatcgcagtcatgagaatcacggctttcaaaccccttcaatggatcggcactgcgtatgtggaatttatccggaacatccctcttctcctcatcacattcgttttttatttcggacttccgaacgccgggctgagactggacggctttcaggcgggaacgattgcgcttacgatttacacgtccgcctttatcgcagaagccatcagagccggaattcagactgtccccaaagggcagatggaagcggccagatcgtcaggcttcacctacagtcaggcgatgagatatatcattcttcctcaggccgtaaaaatcgtcattcccccgctcggaaaccaatttctcaaccttgtcaaaaactcatcaatactcggagtggtggcgggactcgatttgatgtatcaggcggatctcgtgtcctcgagcactcttgtcgtgtttgatgtctatattttcgtcgcgcttttttatttgatattaacgatcccgctcagcatcggggttcactatttggaaagacgtctcggaaagagttattagagaaggagagtgaaaaacatggattttagcggcgcctatacacctgaccatctgctgtttttatgggacggctttttggtcacactttatgttgcgctgatctccattgtcctgagttttattttcgggcttgccgccggcactttgcgctatgcgaacattcctatcgtctcgggcattatagcggccattgtggaaaccatccgcaacctgccgctgttattaatcattttctttacgttttttgcccttccggaaatcgggatcaaactggaaattaccgcggccgccatcacggcgctgacgatttttgaatcggccatgctgtcagaaatcatcagaagcggtttgcaatccgttgacaaaggacagattgaagcggcgcgttcttcaggactgacgtacacgcagactctttttctcgtcgtcatgccgcaggcgctcaggcgtatggttcctccgattgtgagccagtttatctccttattaaaggatacgtcacttgcggtcgtcatcgctctgcccgaactgattcataacgcgcagattttaaacggacaaagcgctgacggggggtattttttcccgatctttctgctggcggccctgatgtatttcgcggttaattacagcctgtctctcgcagccagacggctggaagcgagacaaacgtaaaaaggatacttccggagaagtatccttttttctgcttaaaacattttcatgactcgtcttctcatccgtttcataccttttttattcagcatatcggactgagaagccatacgatacataacggctccagctcctaaagccaacagagaggtcattgttctgcccatcgcgcgtatctcctttcaactttaaaaattgatactgcgttcgtcttcagaaaacaaatcatcaagactgcttaacgtgccgtcttcctctacttgatgtgtcgcaattttgcctttggccaccgtcagctcaatgaagcagccccagcaatagtattggtttacgccgattttgccgatatctttacttttgcagttcggacatacaagcacagactacacctcttatccgttcaggacgatgccttctttccccgcttcaataagcgtatcggcggcgcggcgcacttggcgtctgccagccagatctgaaaagaagccgtccgagagttcatatgctacgattatgcccctgtccaaacaaaagtatacatcttccagcaaaccgaacatttcaccatcaggcgatttcaccggctgcattttaatctgttcaaaggtgaaacagctcttcggcaaaggctgcaaatgagcatgaccggcagctacggcttcttgatccatctcttttatatcacttgcccctaaaaaaagatggcggttgtgaaacaagcgtttctgctccagcacgaaaccgagaaaccggccgtccagagagaaacatacatccgatatcattccgagacttcgcccggtgttttcgtcatatactgttcgtccttcagctgcatggcatgttctcaaagtgtgatcaaccaccttttgttgaacacgtataggttttgccaagaagccgggcagcatactttgaaatgacttccacaggcgaaaaaccggcgcataaacatgtgccgggttttatttacgctttttcttccataaagtcaaaaggcgtgatgccttccattccgatgttcgcatcgtatacactgaacggcagctctttttgcagggcggccagttctgcatccatctcttcagtctgctctgtgagcctgtttttaagcgacgtctgtctgacggtggcatcattgtttttgacgccccattcaagcgcttcttcttctccgcaaagaatcaggaattttttcgctcttgtaatggcggtataaagcagatttctcctgagcattcgatagtagcctttgacgacaggcaggacgacaatcgggaattcgcttccctgcgacttatgaatggaacagcagtaagcgtgggtaaactggctgaaatcctttttcgtaaaggtgatttcgttgccgtcaaacgagacgacgaccatgtcttctttttccgtattttctttggcataaaaaatggacacgatttcgccgatatcgccgttaaacacattgttttccggctggttgacaagctgcaatattttatcgcccgtcctgtagacgacatccccgaatttcagctcccgccttttttctttaggcggattcatgatgtcctgaagaagcatgttcagctcgttaattcccgcttttcccctgtacatcggggcaagcacttgaatatctctggaggtataccccttttttaacgcattcgagacgacctgatccacgacttctttaatctgtgaagaattacagcggataaatgagcggtcctttgtcggcgcggtcagcccctttggaagcagtccttttttcatatcatgggcaagttccacaatggatgatccttcagcctgacggtaaatatctgtcaggcgcacggtcggcagcacttcagaagccaaaagatctctgagcacctgccccggtcctactgaaggaagctggtcttcatcaccgacaataatgagctgaatgtgcttaggaagcgccttaaacaaatggctggcgagccagatatcaagcatactcgcttcgtctataatgatcagtttcccttcaatcggctgatcttcgttgtaggtaaagccttcagcgccattccagccgagcagcctgtgaatcgtaacagccggcagacccgtagattcgctcatccgttttgcggctcttccggtcggcgcggcaagcagcaccggaaacgcctcgtcttttttataatcaccggggtcaagggatacgccgtgcagttcactgtataattccacgattcctttaataacggtcgttttccccgttccaggtcctccggtcagtaaaagcatcggtgaagacagcgctttttgaatggcatccttttggcttggtgcgtattgaacattcatccgttcttccagttcaccgagtgcaagcagaaattccgattcaggaaattgatcggcatactccgtctgagcggcaatgtcgagcacgcgttttgcgacgttttgttccgcgtaaaacaaggacggaaaatagcagcgctctccttcgatgacgatatccttactctccccgagggcgatgatgccgtcagccgcatccatttccgtgacgcggccgccttcagctgactgattcagaagcgtttgcgtattgataatcagctgctttgtttctatgtacgtgtggccctctgaaagacatgtcgattcaatcgtatataagatagccgctttgatccgctccgggtggtttcctgacagacccatttttccgcccagctcgtcagctttcacaaagccgatgccctcaacgtcttttacaagctgataaggattttcctgaattttctccaaggtttccgtttcgtaggcctgatatattttcatggatagctggggcccgaaaccgtattggttcagagagatcataatctgctcaagaccctgatgccgctgcagctctccggcaagcttatccgctttctttttcgacattttcggcacatcgtaaagcaccgacgcatccgacagaattttattgagcgcgccgtctccaagctttttgacgatttcttccgccgttttttttccgattccttcaaacagatcacttgataaatagtgaatgattccttcttttgtggtcggaatttcttttttaaagtgttcagcctgaaattgcaggccgaacttaggatgcgtggcagtttttccgtaaaatgtataggtctcatcttcttgcagcagagggaagtagcccgttacggatacgaccttgtcttcgatcgcctcagacgtttctgcaaccttgactttcagcactgtatacaggttggtgtcattatgataaatgaccgtatgaatgacgccttttacatacggctgttcttcgatgttcagctgatccacgagccttccctccttttgttatgactgggtgataagctgtttcgcatgaagcgcaagcatatgatcaggctgtatgccgattgcgccttccagcatctcaagcgccttttcacgattttctttgtacgcgtaagcgaccccggcattataaaatgcgtccgcgtggcctggatcctgctcgatcaccgtctcaaactgcgcaagcgcttcatccagcatttcttcatttgcaagacacattccgaactggaagcgcgcttccgtgtcattttcgtttaattcaacggcacgctgcaaatacggcagtgcaagcttcggccgctctaatttaacgagaacggtccccagcatataaaacaaatctccgttttccattccggaacgaagcgctttttcaaacatatccttcgcttcggaaaacgattctttcatcacatatacgtttcccgcaccgtaataagcggctgccgccgaattgtccaattcaagcgctctgttatagaatgcaagcgcccgttcgagttcgttcacagaagaaagcagatttgcgaagttgatgtacggcaccgggtcttggccgttttcctcaatcgctttcgtaaaagcctctgccgctttttcaaaatcgccctcctgcatggcgtcaatcccgattttattataatccatttttaacttcctttcgctaaaaaaccccaacatgcgagttgaggttttttacatgtgttatacgtaccacagttttgttccgtctttataaacgtcatctatcgttccgccgccgaggcactcttctccgtcataaaaaacgacggcttgtcccggcgtaacggcgcgtacctgcccgtcaaaaatgatttccgcttcatcatcacccgtcattttcaccgttactttgtgatcttcctgacggtagcggaatttcgccgtgcatgtcatttcgccgctgtccatcagaccgggacgcgtccagctgacatttgtcgccgtgatcttatcggaatacagaagcggattatggaatccttgatcaacatacagaatgtttttttcaagatctttaccgacggcgaaccacggctcgccgcttccgccgattccaagaccgtggcgctgtccgattgtataatacatcagaccgtcatgacgcccttttatttctccgtccattgtcatcatatcgcccggctgagcggggagatattggctgagaaacgttttgaagttgcgttcgccgataaagcagattcccgtgctgtcttttttcgcagctgtcgcaagttccgcttctttggcgatttcccgcacgcggcttttttgcagatcaccgatcgggaacatgactttgctgagctgttcctgattgagctgattcagaaaataagtctggtccttgttttcatccagaccgcggagcatgcgcactgtacctgcgcttctgtccacgcgggcgtaatggcccgtcgcaagataatccgcgccgagtgacagagcatgatccaagaaagccttaaacttaatttctttattgcacatgacatccggattgggggttcttccggctttatattcatcaaggaaatattgaaataccttctcccaatattgcttctcaaaattgacggcataatacggaattccgatctggttgcagacccggatgacgtcttcataatcttccgtcgccgtgcaaaaaccgttttcgtccgtatcatcccagtttttcataaagattccgattacatcgtagccctgctccttcagcagaagggccgccacggaagagtccacgccgccggacatgccgactacgactcttgtatcctccggccgtttttccatttgcattcactccattaaaaacgtaagtccgccgttttaagcaagccgtttaacgacggcggcaagcttttcggcggctgtttcgatttgttccgccgtattgccgaggccgaagctgaggcggattgacgaagtcagcctgccgctctcacttccgaacatggccgtaagcacatgggacggaagaacggatcccgctgtacaagcagatccgctggagacggcaatgccttccatgtcaagattgaccagcagcgcttccaccggcacaccgggaaagtaaaggtttaaaatatgaggcaggcatttctcggcatctccgttcacctccgctgtgacgccggcttcttccagcgtgctcatgatgatgttcttaaactccttatacttcgctgttttctcttccctctcacggtttgaaaggacgaccgcttcttttaagccggcgatgcccggtacattttccgtccccgcgcggcgctttcgttcctgctctcccccaagaagaatcggtgacagcttcacctcttgatttacatataaaaagcctgtccctttaggcccgttaagcttgtgaccggaaacagacagcatgtcaattctgctttttttcacatcaatcggcatataaccgaatgcctggacggcatctgtgtgaaaataggcctgatgcccgcttaacagctctccgatttcgtcaatcggctgaatggttccgacttcgttattgccatacatgacggtaacaaggattgtatcatcacggagcgcttctttcacctgatttgcactgatccgtcctgaagggccggggatgaggtatgtcacctcaaagccgtcttcttccagcttttcgcaggcgtgcaatacagcatgatgctcaacagcggtcgtaatgatatgctttccttcattcttccgggcggcagccgttccgaaaatcgctaaattatcagcctccgtgccgccgcttgtgaaaataatttcctgttctttcgcactgatttcgcgcgcgatgtccgctctcgcttcatcgacccatttccgggattctctcccgaatgaatgaatgcttgacgggttgccgaaactgccgaagaaatggggcttcatttcttcgagcacacgttcatccatcggggaagtcgcggcatgatctaaataaatccgttccattgtctttacacctctggtttaaatatagaacatataagcttcctgctcgccgtccgtgtagctcgcaaggtcttctaacgtcgtgctgtccagcacgtcttttacagcgtcgcggatgcggatccataactcccgcttggcaggctcttcatcctcaagcacttctaccgggctgatcggcccttccagcactctgataatatctccggccgttatctcttcaggctggcccccgagcacgtaacccccgtaagcgcctctgatgctttttacgagtccggcgtttctgagcggtgatacaagctgttccaagtaatgctcagaaaggctgtttgtttgggcgatgcttttgagcgacgtcggaccgtctccatgctttttcgccaattcaatcataatggtgagcccgtatcttccctttgtcgatattttcaatatgaacaccccagtcaattctaattgttaatttatacaagtaaatggatatgaataatctgtttagtatcttatagaccaactgttattataacataacttatcctaattttcattgaaacacggggcccgccgcaattcgcttttctaatcggccgttttccgttaccctgtatatgtaaggagagatgttcatgaaaccattggcatatcggatgcggcctgccaatatcgaagacattatcggccaggaacatttggtcaaagaagataaaatcatcggcagaatggtgcgtgcgaagcacttatcatccatgatcctgtacggaccgccgggcatcggaaaaacgtccatcgccacagcgatcgcaggatcgacaagcatcgcattcaggaaattgaatgccgtcattcataataaaaaagacatggagattgtcgtacaggaagcgaaaatgtctggtcaggtcattttaatccttgatgaagtgcacaggcttgataagggaaagcaggattttctgctgccctatttagaaaacggcatgattattttaatcggcgcgacgaccgccaatccttatcatgccattaacccggccatcagaagccgaacccagatatttgagcttgaaccgttaacacccgatctgatcaagctggcattgaaaagagcgctcacagatgaacaccggggactcggttcctacagcgtttcggtggacgacgacgcgatggatcatttcgcacaaggatgcggaggagacgtccgctccgctttgaacgcactggagcttgccgtgctctccacaaaggaatcaagcgacggcacgatccggattacacgggaaacggcggaagaatgtctgcagaaaaaaagctatacccatgataaaaacggcgatgcgcattatgacgtcttatccgcgttccaaaaatcgatccggggctcggacgcaaacgccgcccttcattatctggcccgtctgatcgaagccggagaccttgaaagcatatcaagaagacttctcgtgatcgcctatgaagatatcggcctcgcaagcccgcaggcaggcccccgggtgctgagcgcgattcagaccgcagaacggatcggctttccggaagcgagaattccgctggccaatgcggtaatcgaattatgcctctcgccaaaatcaaactccgccatctcagccgttgatgaggcgctcaaagacatcaggactggtaaaatcggcgatgtgccgaaacatttaaaagacgcccactataaaggggcccaagagctcggacgcgggatcggctatcaatatcctcacgatttcgagaatggatgggtcgaacagcaatatttgcccgatccgttaaaaaacaagcaatactataaaccgaaacaaacggggaaatttgaagccgccataaagcaagtgtatgaaaaactgatgaagcagaaaaaataaccggacaagatctttcgtgtaaacggcggattcaaataaaaaaacagcctttcctgaagaaggctgtttttctttttacttatctttaacccgtttaatgtcgatgtcctttaagagctccatgacaacatgtccgcccataatcagaccggccactgacggaacccaggcgttggaagacggcggcatttgcgctttgcggattttcgcttcatcattcccgacttcttttctgacgtcttcacggatgacgatcgggctttcatcagaaaaaatgacctgtatgccttttttaatgccctctttacgaagccttgtgcggacgactttggcaatcggatcagtatgggtttttgaaatgtcagcaatctgaaagcgtgtcgggtctgttttattcgccgctcccatgcttgaaatcagcggaacattccgtttcagacattctttcatcagatgaattttataatgaatcgtatctgacgcgtcaatgacgtaatcaagcggatactcaaagaactgctcatacgtctcttctgtataaaacatttttaaggcgacgacgtcacaatccggattaatatcagcgatccgctctttcatcaattctgttttcggctgtcccaccgtcgacaagagcgcatgcagctggcggtttacgtttgtaatgtcaacatcatctttatcgacaagcacgatccgccccactccggacctcgccaatgcttcggctgcgaatgaaccgactccgccgacgccgagaacggccaccgtgctgttttttaacgtgtccagcccttcttttccaatcgctagctcatttctggaaaactgatgtaacaagagactcactccacattctggttttataaactcggcttgtcagaaagccgctggttttagcgcacaaaaaataaagtcccaattgtgccgttgcagctttccttcgttttgaacccgctctcagcaggtgggtgcccttttttaaatcttgtaagtcctctttagcgaatgaaaagaggcatgtacgccatttaaaaatgcgggctcccaaatcaaaaaaatgttcggtcaaaactaggtgtacaactaacacatcaggactttatttaacttgtcaaaatcatatcacagcagattttgattttcaagaaacaaactgctgatctttactgtttcacttttcttttgacagaaaggtgaagttcttcaagctgggcgtcgctcacttcgccgggcgcttccgtaagaaggcagcttgcgcttgccgttttcgggaaagcgatcgtatctcttaagtttgtgcggcctgcaagaagcataaccaaccggtctaagccgagcgcgattccgccgtgcggaggggcgccgtattcaaaggcttcaagaaggtatccgaactcctgctccgcttcttcttttgtaaagccgagaagcccgaacattttttcctgaacgtctttttcaaaaatacggattgagcctccgccgagttcatagccgtttaagacgaggtcgtaagcctgcgctttcatatcttcaggcgccgtttcaatcaggccaagatcttcacggacaggcattgtaaacggatggtgagccgcatagaaacggccttcttcctcgtcatgctccaataacggccagtccacaacccacaggaagttgaagaggctttcgtcaatcaggccgcgttctttgccgagctttaagcgaagcgcgccgagggattgagccacaacctcaaacttatcagcgccgaacaggagcagatcgccttcagaagcatcaagcgcttcagccagttttgcctgcttctcttcatcaaagaatttcgcaatcgggccttttacgccgtcagcttctactttcacccaagcgagacctttcgcgccgtaatttccggcaaaaacgccgagcgcatcgatatcttttctggaatagtcgccggcagcgcctttgacattgatcgcttttacaacgccgccgtttgccacggctgatgagaacaccttaaattcagtatctctcactatgtctgacacgtccgtcagcagcatgccgaagcgggtatcgggtttgtcggaaccgtagctgttcatcgcttcttcatatgtcattcgcggaagcggaagcgatacttcaacgccttttgtttcgagcatgactttcgccatcatctcttccgccagagccatgatgtcctcttgactcataaaggacatttcaatatcaatctgcgtaaattccggctggcggtcggcacgcaagtcttcatcgcggaagcagcgggccacttgataataccgttcaaagcccgacaccatcagaagctgtttaaaaatctgcggcgattgcggaagggcgtaaaattccccttcatgcacccggctcggcactaagtaatcacgggcgccttcgggagaactttttgttaaaatcggtgtttcaatatcaagaaatccgttttcatccaagaaatggcggatggattttgtgacttgatgccgcatttgcaatgtttgaaacatcgccgggcggcgcaaatccaaatagcggtgttttaaccggacgtcttcagaaacctcagccgcctggtcactgatcggaaacggaggcgttttcgccgtactgagcaccgtcaccgcttcagctttgatttcaattttaccggttttcaggttgggattcaccgtgccttcttcacgggcagaaaccgtgccttcgatatcaagcacatattcgtttctgattgcttccgctgcggcaagggcttccttcgatacgtcagggttgaacacgacttgcacaatacccgagcggtcacgcaaatcaatgaaaatcaagccgccgagatcgcgccgcttctgcacccaccctttcagtttgacggtttcgccaatcgctttttcagttatctcgccacaataatatgttcttccaaacatagcgttcctctccttcactgcttttgatctgcctttaacacttgtatcagctcgtctaacaccacttcacgctgctctcctgtttccgcatcttttacattgattttattttgggcaagctcatcttcccctaaaatcgcaataaaacgtgcgccgagacggtcagccgttttgaattggcccttcatctttttattttcataatcgatttcacttgagatgcccgcttctctcagtttgtacacgagggaaacggaataatccttcgctttttctccgagcgtcacgatgtagcagtcgatcccctgattgacgggaaggtctgttttctcagcgtcaatggctgccagcagtcgttcgatgctcatcgcaaatccgatacccggcgcttcaggtccgccgatctgttcaacaagcccgtcatagcggcccccgccggcaagggttgtaatcgctccgaatccttcggcattgctcataatttcaaaagcggtatggttataataatcaagccctctgacaaggttcggatctatttcgaacgggatgccgagaccgtttaagtattgttttactttctcaaaataagcggctgattcttcatttaagtaatcaagaatggacggagccgttttcatcagttcatgctctctgtctttcttgcagtcaagaattctgagcgggtttgtgtgcagacgcgattggcagtctgagcaaaattctccgatgcgcggttcaaaatgtttgacgagcgcttcccggtaggatttgcggctctcctggtcaccaaggctgttcagcacaagcttgacatgtttcaaaccggctttacggtaaatactcatcgcaagcgcaatgacttctgcatccacggccggatctttggagccgatcgcttcaattccgaattgataaaattggcggaaacgccctgtctgcggacgttcgtaacggaacatcggtccgacataataaagcttcgtcggctgcaccgggttcgcaaataatttattttcattgaacgcgcggactgcggcggctgttccttccggccgaagcgtcaagcttctccctttgcggtcttcaaacgtgtacatttctttctgcacgatatctgtagactcaccgacgcctcttgcgaataattccgtatgttcgaagatcggcgtgcggatttctttatattgataagtgcggcacgtctccctcataatttgttcgacgaactgccatctgtctgattcacccggcagtatgtcctgtgtgcctcttggaatgtgatatgccatgttacaggcctccttaatgtctttcttcaaataaaaaaactcccgctcctactatacatgtatagtagggacgagagttatacccgtggtgccaccctagttggaatgccgaagcatccccgctctgacctttaacgcaggttcacgtccgctgcctaatgacttgcaaaagcgttcagcagggaacctccggagtgttgtttcgagaaagatgcagtgcggatccgctttcagcccgggacggttcctctcttttccatgcattctgacctactcttctccattatcggttcaaaatcgttatcatgagttatgtacatcaatttctattataataatgggattgcactcccctgtcaagttttattccgtctgtttttccttgcgaccgcttctttcgataagagaccgaactccgtcgccgtctcttcaagaaaacccgccttttctctatcgctctgatcactgaaatgcagatttccttccgcatcgtgcagcgcgcgccccatttttggttgatatttcatgatttgcacaccttttcgctgtatttatgactagtataaacaaaccattttatttttatttaacattcagcaaggaaaatacgatattatacaagaatgtattttagttagttcagaaaggaggacagccatgaagaagagaactcttgctcttattttatgcggcgtcatcatcacagcgcttcttccgtcatttcacaccgcaatcgccgcagagggagaagcggtcatcgcgacagacaagatcaatgtcagaggcggtcccggcctgagctacggaataaaggctgaagtaaaaaaaggggaaagatacccgatcgttaaagaagagggagactgggtacagcttcagctgagccccggtaaaaccggatgggtcgtttcctggctgatatcaaaaacagccgggggagcagacaattcatccgcaaaaagcggaacggtcacttccaccgatcctgacctccgcatcagaaaaggcccggggacatcgtatgaagtcatcggcaaacttccgcaaggcgcgcatgcatccgtgctggacaagaacagcggatgggtgaacatttcttatcaaggcacaaccgggtgggtttcttccgaatacgtcaccgcggacagcggcggatcggatacgaaagcaacttcggcccgaagcgggtcaaaaagcgggacggtcggcgtttcttcattgaatgtcagaagtgcagcgtcacatgattcagcgattatgactaaattatcacgcggaacaaaggtttccatcttaagtgaagaccacggctggctgaaaattgaagcaaacgggcaaaaaggctgggcagcaagccactacatcataaaggattctgactcatcgggcagcgcatccggctcgggagacggttctgcgggctcaggctcctcgaaaaaagcgtatattgtttacagcggcaccaacttaaggagctcggcctcgacttccgcttctatcgtaaaaagagcagataaaggcgcagcctacccgattgtcggctcaagcggcaaatggtatgaagtccggcttgaaaacggacaaaccgcatatgtggcagactgggtcgtacaaacgtcaaaaagcggtgaggaaacaggcgaagcaccttctcccaacacgtcaggcggcagcggctcacttaaaaacaaaacgatcgtcgttgatcccggacacggaggaaaagacagcggaacgatcggctactccggaaagtttgaaaaaaacgtaacgattaaaaccgctaagctgttagccggaaaattgagagcggccggtgcaaacgtgtatatcaccagacaggatgatacatttatcagcctgcaggccagggtttcaacctctcattaccggaatgcggatgcctttatcagcattcactatgacagctatgccgatacgtcaacgagaggaagcacggcttattattacagtccgtctaaggaccgccagcttgcctcagacgtccattctgaagtagtgaagcgttcccctattcctgatcgcggcgttctgtttggcgattattacgtcctgagggaaaataaacggcctgccatgctgtatgagctcggctatctcagtcaaccgcaagaagaaacaatcatacatagcggctcttatcaggaaaaagtgacagacggaattgaaagcggattggaacattattttcaatcataaaaaaaaagctgccgaacggcagcttttttattgtttagaatccataatcaatgtaatcggcccggaattcgtcagctgaacatccatcatggctccgaatattccggtttccactttgactcctttttcccgaaggagttcgttccacttttcataaaggagcacagcctgatccggtttagccgcattcataaaattcgggcgtctccctttctttgtttcgccgtaaagcgtaaactgggaaacggataaaatctccccgcccgtatccaaaagcgataaattcatcttgccgctttcatcatcaaatatccgaagattcacgattttatccgccaagtaagcggcatcttcttctgtatcttcatgagtgatgccgacaagcgccataataccgggtccgatccggccggcgacagcgccgtcaaccgtcacactcgcttctgttacacgctgaacaactaatttcatagcaagctccttttagttcattacccgccggactgaatagatgtctctgatctgtttaatccgctcgaccactttgtgcagatgattgatgttttgaataaaaatcgccatatgaatcgtagcgactttattgcggtcggatttgccggagacagaggagatgttggttttcgtttcatttacggcttggagcacctcatttaaaagcccgagacggtcataccccaaaatctcaatctcaacgttatattctttgcgtctttgaacctgtgattcatgctcccattcaacgggaatcagacgttcctgcgcttcattcgttttgacgttcggacagtcgtcccggtgaacggatacaccgcgcccttttgtaataaaaccgacgatatggtcgcccggcaccgggttgcagcatttcgacaagcggacgagaaggttgtcaatgccttttacgcgcacacccgcttcccgttttctcccttgaggataatgtttcggctcggaagtgacttcctgaacgattttttcctgctcttcctggtcacgcagcttccgttctttttcggtgagcctgttggccacctgaagagcggtaatgccgttatacccgaccgccgcgtacatatcctcttcatttgagaaattgaacttgtcggcaaccttttgaagattttcgagtgttaaaacatctttcacttcaaaatcaagatttttaatttctttctcgacaagctcacggcctttttcgacgttttcttcccggcgctgtttcttaaagaattggcggattttgtgtttcgcctgggacgtctgcgccagtttgacccagtcttggctcggaccgtaagaatgcttggacgtcagaatctcgacgatgtcgcccgtccggagcttatggtcaagcgtcaccatttttccgttcactttcgccccgattgttttgttgccgatctccgaatggatcctgtaggaaaaatcaatcggcacagagcctgacggcagttcaatgacatcgccttttggcgtaaatacgtataccatgtcagaaaacagatcgattttcagcgattccataaattcttccgcatcggtagactcgttttggaattccagaatttcacggaaccaggacagttttttctcaaatgtcgcttcttcgtttgcagccttgccttctttatatgcccagtgtgcggccaccccgtattcagcgatctcatgcatctcaaacgttctgatctgcacttccagcggatcgcctttaggcccgattacggtcgtatgcagagactgatacatattcggcttaggcatcgcaatataatctttgaatctgcccggcatcggcttccagcacgtatgaataatgccgagtacggcgtagcagtctttaatgcttccgacaagaatacggacggcgagcagatcatatatttcattgaactgtttattttgcagcgccatcttgcggtaaatgctgtagatgtgcttcggacgtcctgaaaagtccgctttaatattcacttcttcaacgcgttttttcacttcattgacaacctcttcgacataaagttcgcgttccgcgcgctttttcttcatgaggttgacgattctgtaatattgctgaggattcaaataacggagagcggtgtcttccagctcccatttgatcttagaaatcccgagccgatgggccagcggagcgaaaatctccagcgtctcatttgaaattctccgctgcttttcctgcggaagatgctttaacgtccgcatattgtgaaggcgatccgccagcttgatcaatatgactctgatatcctgagccatagcgacaaacatttttcgatggttttccgcctgctgctcctcttgagatttatacttaattttaccgagcttcgtcacgccgtcgacaagcatcgccacttcttcagaaaatgcttccttcaggtcgtcgagggtgacatccgtgtcctccaccacatcatgcagaaatccgcccgcaattgtggaagggtccatttccagatcgacgaggatccccgccacctgaatcggatgaatgatgtacggctcacctgatttgcggtactgttcgcgatgcgcgtcttgcgcatacaggtaagctttctcaacaaacgcaatctgctcctccggcagataagtgcgcgctttatctattacttgctcggcagtcaatacttgttcgttcgccatggaatcaccttttttaaatgtaaactgtattagtttattatcaagaaaaaaacgagagatgtaaagggcagaagttcaaaacacctaaagaatctgtcaggatgatgaaataataggaaaaaagcaccctgacacgagtgcttttttccatatgcggttaatatttcattaatgttaaaatatcgtaatcgtcaagcttgtctctgccgtcaaggtaagaaagctcgattaagaatgcaataccggctacgacgccgcccagttcttcgacaagcttaatcgttgcttcgatcgtgccgcctgttgcaagcaagtcatcagtaatcagcacgcgctgtcccggcaggatcgcatctttatgaatcgtcagtacgtcttttccgtactccaaaccgtaatcgactttaatgacctcacgcggaagtttcccttctttccgaaccggggcaaagccgactccgagcgcgtatgcaaccggacagccgataataaagccacgcgcttcaggcccgacaactaaatcaatttctttttcttttgcatattcaacaatttggtcagtggcgtaacggtatacgtcgcctttgtccatcaatgtcgtaatatctttaaattgtacgccttctttcgggtaatcgggcacaattgttacgtattttttaagatccatctgttctatgtcctcctcgtactttcataagcctctgaaccttggttcatcagcttattcagccattccttcagctcatgggctgcggaataattgagcttctggtctaattccatcagctgctgttttacctgataggtttgcgaatctgccaggtcgcgttttttcgcgccgctcacgacagacagcacaccatcttctattttaacaaaaccgagatcaaaaaacacctttgtcatgaaattgattgtgtcaattgaccatcctctgtgtctcgcaagctctgaaccatgcttgccgaagtcaaaagcgccccttttcaagagaaatgcgtaaaaccacttgaaatcattccgcgatggaaatgaggacaggaaatgttcttcatgattgataaaaacaaaataaatccgttccggcttctttccgtcaagcaaatgctgcaggcgatccgctgacggcggcacatccagaaaaacggcatattttccgtcaagctggagagcttccgcctcggattccgaagtgatctcggcaagctcgcccgtcagctctttttcacggagcttctgagcggttttttcgttaaagctgatgagcacccgtttttccttcggcagtgcggtgaccgtatcttcccacgtccgcttgcctcgaatatcaaaaagctgccattccggcaccgcagcatctttaatcatcagctggggcttctttctgttgttccattcattaatggacatctcgccgacaatggaaatcgttgatccgggaacaactccggcttccagctctcctttgttaaagccgacgcagtcaaggacggcggaatcacttttcaccgtcattttcacgtggtttttattcgctccgatcaggcgcacatcatcaagcacggcatttttcaccatcacatgcggtttagggttaagcatgccgaacggcgacagcatattcaattctgtaatgctttcaacggttatgtcttcaacgccgcagacaagatcaacctcctgaacgggaataaaatcctcttccgtaagggtttcttcagccatttgattcagcctgtcccttaattccgccacatcttcagccttcagcgtcattccggccgccatcggatgcccgccgaaatgaggaagaatgtctctgcactgtgaaaggctcgtaaaaaggttgaaacctctgatgcttcgcgccgaccctttggcgattccctgctcctcatctatcccaagcacaacagcgggccggtaaaaacgttcagccagcttcgatgcgacaataccgacgacgcccggattccagccggcttttgccactacaatggcagacgggtttccgccttgttgctgtaccatttcaacagcctcttcggtcatggttttcaccattttctgccgctctttattcagccggtcaatatccgaagccagttcctccgcttcaaactgatcttcggtcatcagcaggtgcacagcgggatcggcctgttctattcttccgacggcattaagcctcggtgcgacctgaaatccaatcgtttcctcatcagcttgtccgatatctccgccggaaagcttaatcagagctttgaggcccggccgatttgtcgtacgaagcctttcaattccgagtgacgcaattaatctgttttcatcatgaagaggcaccagatctgcaaccgtaccgattgccgccaagtccagcatagcttccggcaaagaacccgtaagcgcgtgggcaagcttaaacgccacaccgacgccggccaattctttaaacggatagccgcatcccggctgcttcgggtggatgatcgcaaatacgtcaggaagctcgggtcccggctcatggtggtcggtaataatgacgtctaagcccagctcttttgcgacttcagcttcatggacggcggcgattcccgtatccactgtaatgatcagcgaaaatccccgctcttttatggagcggaaagcttgttcattcgggccgtagccttctgtaaaacggtcgggaatataaaagtcaacgtccgccgacagctgtctgagtgccgtcagcatcactgacgtgcttgtaacgccgtctgcatcgtaatctccgtaaatcataatcggttccccttgagaaaccgccagttttatccgatcaactgcttcccgcattccctttaattcatacgggtcataaaagtctgcatcctttgtatgtaaaaacagccttgcgctttcggcagtatcaaaacctctttttacaagcagtgatgccacaagaggtgttatgtccaattgttctgtgagtgatttgactttttcctgatccggctgctggatttcccagcgcatttttgacgctaacataaattcacccctcaaccaccctattatactagagcggactgaggggtttcaaatgttattctgatccttttttctcttcaagcatttcttccggcggagcggctgtttttttgccgtccgaatcagccgtcaattcacctgcggatctgttttcttcccgcagcattttaatttcgcgcttcagtttcatcacttgaaagataccggctgaaaacacgatcagcgctcccattaacacagagcctaaaatgactaaaatcagcggccattcagcggttccgaacagataatcaacctcaaccgcccgcacgttaatgacggcaaagatggcgacaatcagagtaaatagtaaagcgaatataatagtccattgtttattcatgcgtctgcccccaattattgattcttatcttttcccccgttttcccgggagtaaaccccggcctcaggaaatccgggccgtcaactgctcgcggaccagctttttcagtccgcttctttctcccgatatgacgagggtgtccccttcttcaattacggtatcaataccgggactcagctgtttttgccggtttttcttcacgatcgcaataatctggacgttgtaatgtttcttgatctccaaatctccgattgtacggctgacagccggtgcatgagattcggctttaaaccactcaatgacgaggtcatcaagcgcgacttccacagattccagcgctttcggcttatacgtcatcccgcctaaaatagcggaaatctgccttgcctcttcgtcgttaaattcaacggatgccaagcattcgtcatgatcattctcatcgaagtaatagagctcttttctgccgtcatcatgaagaataatactgattttatcgtgatttttcgtaatgacttctactttctggccgatgcccggaagctccgactcacgaacgttcataagaaccctcctacatgtttttacaatgatgattgattatgtaagcgtatgtcattatagcaaatgcaggttttaagttcaatgcggcctaaaaaaaacaggctgccttccggaagacagcctgtttccttttactcttcgattgattttttccctttaaattcttttcctttccatacaagccacagctgcgcggcgatgtaaagagaggaataaacgcccgtcaataaaccgaccaataaggcgacggagaagtttgtaattgacgatgagcccaaaatgagcagcacgacgacaacaatcacaacggtcaagaccgtattgatcgaacgtgtaaaggtttgctgcaaactcagattcacgatgtgttccagatcggcaaatgacttcggcttgcgttttttcatctgctcgcgtatccggtcaaatgtaacaatcgtatcatttatcgagtaaccgattatggtgagaatagcggcgataaaggttacgtcaacctccagccttgtaatgctgaaaaacgcgacgataaagaaagcgtcatacagcagggatacaattgcggcgatagccattctgtactcgaaacgtattgatacgtaaataatgatgccgattgatgcaattgccacggcatataaagcattacgggccagttcttttccgactgtcggcgataccgtgctgacgttcggttcagatccgtatttgtccttaaagtacgttttgatttcagcgattttttctttggatggctctccgacaaaccgggccgcggcaacatggttctctttacccgagagcacgatgttttccggatccatgccgagagagtcaaagtctttttcaacctgctgcgccgtcaatgcatgattgctctgcacgtcaatccgcgccccgcttgcaaaatcgattcccaggttgagcttaaagaccagcaagatgataattcctgcaatggttacagcgcttgagaaaataaagaaatattttcgcttgctcgtgaaatcccatttttggaatgccgtatgcggttcagtattttcatccgttttttgaatgtccataatatgttttttcttgacgccgaaccagccttttttccggtcaagccatctgctttccacgagaagggagagcaggaatcttgaaaggaagacagctgtaataaagcttgtcagaattgacagaatcagcatcgtcgcaaacccttttacagagcttgtcccgaaaataaagagcacgaccgctgcgatgatcgttgtgatgttcgcatcgaaaatcgtcgcgaatgaccgtctgttccctgaacggaaagctgagcggacggatttgccgagtttcagttcttcttttatccgttcataggtgatgatgttggcgtcaaccgccatcccgacacccaaaatgagagccgcaatacccggaagcgtcagcaccgcctgcatccagtcaaacacttgaagcgtaatatacacgtatacagaaagcgtaatgaccgctatgagtccaggcagtctgtaataaagcagcataaataagaaaacaattgcaataccgatgatgccggcctctaccgtatcatgcaaagcctgctgtccgaattgcgcccctactgaagtagagtatttttcggtcagtttcacaggcagcgcgcccgcgtttaaaatattggccaagtccttcgctttttgaacggtgaactggccttcaatcgtgacatccttcgtgtttaattcctggctcacattcggagcggatacatatttcggatgttttttaccgacttcttttttaaatgaatcgcctttttggtaatcaagccagatcacaagctgattatttggcgccattttcttgacttttttcgtcacttctccgaacttatccgcatctttcagcttaacgctgacaatcggttcgttcgtcgtcggatcaaaggtttgcttcgcgccgttttccacgagatcagagccgtttaacagctctttatcattcgtatccctgaacgagagctgcgcttccgttgacagaatttcgcgcgccctgttctggttcgtgacgccagccagctgaacgcggatacggttatttccttcaatctgaatgttcggctcgcttacgccgagaacgttagcccggcggttcagcgcctgcaccgtgctgacgagcacgtcttttgtgattttatcgccttttttgacgggctgcacatcgtacagaacttcaaacccgccgcgtaaatccaatcctaacgtaatattatcggcagccggttttgtaaaataccccagccctgtgccgatcaataatacgatcaggaaaaacgcaatcaagcgtccttttttcattatgtatttcctccttaaacctatgccgtcaaatcattatctcagcagttcatccaaagcttcctgaccctcatcgctttccagccaattagacgacttaaaagcttcaacggttgcatagttcataaaatcgccaattttaactgataaaatatgaccggccaattcatgcagcggcagttcctttttctgtttccactttttatgtattaagtatgaccataaactctcgtgctcaacatcatcgtatccgaggattttgaactcttcaagtttactgtacaagaaaggccgcaaatgatctttgtacatttcggcgggatgtttctccactgggcgctcgctcctttttccatttttctcgaagacttgtcatgctcggacgacatcggcgcatatctttattgtatatgattccaggtagtttgagaaggcaggggtttataaaatggcaaaacagacttttttaaggggcactcttattctcatcgcagccgggatgattacgagaatgctcggctttgtcaaccgggtggttatcgcccggtttatcggtgaagaaggggtcggtttatacatgatggctgccccgacatttttcttggccaccactttgactcaattcggcctccccgttgccatcagcaaacttgtcgctgaagcaagcgcgcgggggaccggcagaaaatgaaacacattttagtgatgtcgcttaccgtcactgggatattaagtctcatcttcacgccgctgtttttatgctttgcgccgattatgtccgaaacgatgctgacggatcagcgcacggtttacccgcttctggcgattacgcccgtcgtgccgattatcgcgatctccagcgtgctccgcggttactttcagggcagacagaatatgaacccgctggcgttttcccaagtgcttgagcagatcgtgcggatttcacttgtcgcagtctgcacgacggtgtttctgccgtacgggattgaatatgccgcagcaggagccatgatttcgtctgtcatcggggagcttgcctctcttatttatttattcatttgttttaaagcaaataaaacaatcagaatcagaaaacaatttttcaagtcgatcgcaaatggaaaagaaaccttccgccagctgatgagcgtgtcgctcccgacaaccggaagccgcttcatcggaaatttatcttggttttttgaacctattgtcgtcgcgcagagccttgcgattgcaggagtggccaccgctgccgccaccagccagtacggagagctgaccggatttgccatgacggttttgacgctgcccagctttataacctattctctgtcaacagcgcttgttcctgcgatcagtgaaggaatggagcaaaaaaagctgcaagttgtcgaataccgtctggaacaggcgatgaggctgtgtcttttaagcggaggcatttcggtggttattttattctctttcgctgatgaactgatgtccgtcatgtacggatcaactaatgcggcggtatttgttaaagtgatggcgccgttttttctgctttactattttcaggggccccttcaggcggtgctgcaggctctcaatttagccggggcagccatgatgaacagttttatcggcgccgctgtcaaaaccggcctaatttttgttttggcgaccaggccctccttgggcatcatgggcgccgcacttgcgattgtaacggggatggtccttgtcaccctgctgcatgcggccaccgtaagcaaggtgcttccgatcagcattaaaataaaagaatacgcgctctgttttgccgtcatattcatttgcggttatgtcagccgcatcatcaagcacgccgttcatttttcaggatcagaggctgttaatctcacaggctggattgcaatgacggcggctttgtacattgcgcttcttctgttattcaggctgattaaaagggaagagctgatccggattccggtcatcggcaagttcgtgacgcggtgaaaccgatttatggctcccctttttcatctttaagatcaataaaaaaagcgccgtccgtaaacgtgcagaatgatataaccgaaagatcgcgatatcctctttttgctaaatttttttcaagccagtgtttatctttcccgattctgtccagatgctcgttctgaatgaccccgtcaacgataagcgatgtttccatctgcttatccttattgtttttctttttgacgattgacagtttgcccgaagactccaaaatggcgtacgacacgtcagagattctatcgatgttattctccctcagctgcataagaagatcgtcaaaattgtagcgctgcgatctcatcgcccgttcatcaatttttccctgttttataataatggtgggttttccgtcaagcagctgccgtattttttggcttttgagcgaaataaaagcaaggcttacttgaataatcattaaaacgacaatcggcactattgtgtgcaaaagcttatcttttacattttcaattgccaatacggcaatctcggcaatcataatggagacgacaaggtctaaaatgctcagttctccgatttcccgttttcccatcagtctgaaaatcacaagaatgataaaataaagcacaatcgtacgaaacgtaataatgaaaatatcttccatatcgcacctccaacggtcatagcatttgccatcggctctgaattatgtaataaacgggctgaacatcatgcatttacgtctaattcgaacattcagagaatacatttagaaaaagacgggctccggcttgtcatatatcaggccgcagagcggagaggagataaaaatggaagaaacgaaacaagtgggaagaggcgttttgtacggtttagtggctatttttgcggtgatgcttcttacaagtttggcgatttcgcttttactgacggttacctcaatggaagaatcatctttcagctggctgatcaccgcgctttcttttctttctttatttgcgggaggttttatatcgggcggcaaagcgaaggaaaaaggctggatgatcggagcgttaaccgccgtctgtttttcattaatcatcttgctgtttcaatatttagggttcggaaaaacgtttacatccggtcagcttttgtttcatctcggctttttgggagtcagtatgctgggcggcattttcggagtgaatttgaaaggaagcagatcagcgtaataaaaaaagagcggattctccgctctttttttgtatgtatgagcttcgctgttattcagcggaagcttctctgattgcgcggcggtcaaatgttaaacgggtgttatcacctgttttaatgacgaccttgctttcatcaattgaatcaacagtgccgtgcaatcctccgattgtcaccactgaatccccttttttcagctcttcctgcatctggcgtacggccttctgctgcttttgctgcggacggatgagcaggaaataaagcactgcaaacattaaaataataggaacgattgtgcctaaagtacccatctgtttccctcctttcaagaatggttttatttagaagcttttcgcatttggcttattatagccgtaacgctcaaagaactcttctcggaaatcaccaagacgatcctcccggatggcttgtctgacctgctccattaagtgtaacagaaaatgaaggttatggtaagttgttaatcgaattccaaacgtttcattacagcggatcaaatgtctgatgtaagcgcgggagtaatttttgcatgtatggcagctgcactcttcgtcaatcggacggaaatcacgctcatatttggcgtttttcatattcagacgcccttcattcgtaaacaccgtgccgtttcgggcaatccgggtcggcagtacgcagtcaaacatatccacgccgcggatggcgccgtcaattaaggcatccggtgaacccacacccattaaatatctcggcttgtccttcggtaaaagcggagttgtaaactcaagcactcggttcatgacgtgcttcggctcgccgacagataatccgcctatggcataccccggaaaatcaagcgaaaccaagtcttttgcactttgtgtccgcaggtcttcgtattctccgccctgtacgatcccgaacagaccctgctcatctgagcgcccgtgcgcctccaggcagcgttccgcccagcggctggtccgttctacagagcgtttcatgtaatcatactctgccggatacggcggacactcatcaaacgccatcatgatatcagagccgagggcgttttgaatttccatcgctttttccggagataaaaacagcttgtctccgtttaagtgattgcggaaatgaacgccttcttcttctatattacgaaacttgctcaatgaaaagacctgaaaaccgccggaatctgttaaaatcgcgcggtcccagttcataaacttatgaagcccgcccgcttcttttacaatgtcgtgtcccgggcggagccataaatggtacgtattgcttaaaataatgcccgcatccatagatttcagctcatccggagacatcgtctttaccgtagcaagcgtgccgaccggcataaatacaggcgtctcaaaggagccgtggggcgtatgaactctgcccagccgcgctcccgtttgtttgcattcctttataaattcataacgtatcggttgttcagccactttgtatgaggcctcctgtcattcaaattagataatcagcatggcgtcgccaaagctgaagaaacggtattcctcttctaccgcatgacggtaggcggaaagaacatgctctctgccggcaagcgcagaaacgagcatgataagggaagatttcggcagatgaaaattggtgatcatgccgtcaatcgctttaaattcatatcccggataaatgaagatggacgtccagccgcttgaggcggtaaatacgccgtcatgctcgccggcaatggtttccagggtgcgcgttgatgtcgtcccgaccgacacgatgcgccctcccgcctttctgacctcgtttaaagaggcggcggtttcttccgtcatttcataaaattccgcgtgcatgttatgctcttccacatcatccgcactgactgggcggaatgtgccgagtcccacatgaagtgtgataaattcaatccgcacacccttttgctgcagctcgtccagaatctcttccgtaaaatgaagtccggccgtcggagctgcggcagatccgatttcttttgaaaagacggtctgataccgttctttatcatcaagctgctctttaatataaggaggcagcggcatttcaccgagtgattcaagcacttcgtaaaaaatcccgtcataccggaattctatttttctgcctccgtgatcaagctcctccgtgcagaccgctgtcagccggccgtcgccaaatgtcaggaccgttcctttttttacgcgtttcgccggctttacgagcgtttcccatgtatcattttcttcctgttttaataacagaagctccactttcgctcccgtatcttcttttgtgccgaataatcttgcaggcagcacacgggtattgttcaagacgagacaatccccttcattaaaaaagcttacaatctctttaaacgaactgtccgtcagcccgcccgtctgtttgtcgagcaccatcagccgtgatgcgtcacgctctttcagcggcacttgggcaatgaggcgttcaggcagttcaaaatcaaataaatcgactttcatcatttcacctttattctgtctattgttatttcattctgccgaaaaaattaagcagaatggatagtatcacactgatcacaatacaagtgacaacgggaaagaaaaatgtaacatttcccttcttaacgaaaatatctccgggcagccttccgacaaagtgccagactgcgccggcaataagcaaaacggcaccgagaaccatgagaaccttcggaaagtcagtcacgggcgggcgcctccaatcgaaaatgttcatacacagccggagtcacgacccgtcccctcggcgtcctctgtagaaatccgatctgcagcagatacggttcgtacacatcctctattgtatgcggttcttcgccgattgtcgcggaaatcgtatcaaggccgacaggaccgccgctgaatttttcgatcatgcccatcagcagcttatggtcgatatggtcaaggccgagcgcatcgacttgaagacgttcgagcgcgtcgtgagcgatttcttccgtgatgcggctgtcgccgagcacctgggcaaaatctctcacccttctgagaagccggtttgcaacccgcggcgttccccttgaccgtctggcgatctccagagccggagcttcttcgatatccacttcaaaaacgtcagccgttcttgacacgatatctgtcagctcttcctgcgtatagtattcaaggcgcgacagcaccccgaaccggtctctgagcggtgcggtcaataatccgacccttgtcgtcgctcctacaagcgtaaaagggggaaggtcgagacggacggagcgggcggacgggccttttccaatgacgatatcaaggcagaaatcctccatcgccgggtacagcacttcctcaatcgagcggttcagcctgtgaatttcgtctataaacagcacatcccctggttcgagcgccgtcaaaatggctgccaaatctcccggtctttcgatggcgggacctgacgtcgtccgcatctccacccccatctcattggccacgatagacgcaagcgttgttttcccgagacccggaggcccgtataaaagaacgtggtccagcgtttcctgcctcattttcgccgcatcgataaacacgcgcagattttctttcaccttcttttggccgatatactgggcgagattctgcggcctgaggctttgctcgattattgattcatggctgtctgcttcacttgaaacgagccgttcatccatgaacatcaccttactttaataatttttgcaatgcttttttcacatattgatctgttgaaagcgccgtttcctcttttaagtgaggaagcacttttttaatttctttttcggcgtagccgagaaccctaagcgcttcaagcgcctcgtcaagcgccgtttcagcctcttgtttttcaatgcgcgcttcatgattgaacaggttgtcaatcatttcaggcacgacgtcggccagtttgcctttcaaatcaagaataatctgccgcgccgtttttttgcccacacccggaaatttcaccaaaaaggcttcatcttcctgttcgatcgcttcgatgacggctccggggtcaccggaaccgaggatggcgagcgcccctttcggcccgatgccggtgacgttcagcagctttgtgaaaagcgctttttcttcccgggttgaaaaaccgtacaaagaaaaggcgtcttcttttatatgatgatacgtaaaaatggtctcttgattgcttaccttataaataaacggattcggagtgaagacctgatagccgattccgccgttttcaatcacgatgtattggggagatacataatcaatcgtccccttcacgaattcaatcacacctattcacctctttgactgcttatcattgtaacacaaaaacagccaaagtcttatagaaaagttaacgtatgttcgctttgacaccttccattcagaaaaaaaagacatgtgtcacatgtcttgcgtcaaagtcagccgctgtaagtcttaatatgatcgatcacgctctcaaactccgcttttgtcctgtacggtatgccgtgttccaagtgcttttgcaatcggctttccagcctttctatatcaatctggaagaaagattgaatcggctcggccagcgatccgggacggccgtgaaaagtggagatgacgcctccgtccgtgacgccgatataaccgttaaccttactgagcggagaaatgtcatcaacatgcttacggaaaaggacgaagccttttttctgctcaacgagcgtccagcccgcatatgcggcccaaaaatcctccatcgccaaaacggtttcatccgtatgttcgatgccgacatcaccgtccagatagaccttttccagctggacgtgcacccgaagcggcccgtaatgctcaacctccgccccgtatgcgccttttcctccgcaaatcaggactgcagccgataagataagcataaacaatagacgagcaccgcaaattcgtttcaccaataacacctctttattcaatcaaactcttgatgctagtttgaccaaagatgccggtgcttaaccgttttctttcatttgtctgtttcagccggaaaaaagcagcctctatatgagggctgccccgatgattatgcccggccggctgaaatcagtttcatttgtccgggcgtcagtttgagccggtatccccttacggtcagatacacagtttttgctccgcggcttttgtcatgctccgtttttttcattccggcccctccgttacgttttattacttttatgttaccaccgcaacataaagagcgttttaagaatatgtaaagaaatgatgaagctttatccataaaaatactgccggatgaaatcatccggcagtcccgtttaacggctgtttctgttcatgtcttgcagctttgtaaaagtagcgttgtcggtaaacacttgaattgtacggccgtccgcaaatttttggccgcatgtttgacatgtttatcatcatttttcgtaaaaggatgatttgttctgacggcaatgacgactctcgtgtcagtcacgatgacctgactatcctgtacgccttttacttttttcacgcggtttgcaacttttgccgccagcctgatgttttcggcgttgtcatacccattataagacattgctgccggcggcgtattgacatttcggccgttatatgtgccgtccgtcgttaacggaaccccgtcattaggcgcatactggtcggacacgtttgtcgtattatgacggccgtttcggttttccatcatttcagaaacgggtccttgatggtccattccgtactggcgtctgccgttatcattatcattcgaataatatccgaccggacgtgttgactgattgtagcgtccgtcattcatggcattatttgctccgcatgccgttaagcttgccgtcacggctaaaacgcctgcgatcgtcatcagttttttacccaatggaaaaaccccccgtggattcatcgctgtttgagcgttttccgctcatgtttaggatgtgcggccgacggcgggtttaagcttgtcagttatgtccattcctcagtcggacataaaaaaaggaacgacatacatcgtcccgaaacattaatcttcttcttcctccggccgtccgaatacttgatttggactcggctgattcggcgcggcattaggatttgctccgccgtaaggcataaaatatccggcgtttgcacccacattcggatacggctgcacaggcacatttgcgtgatggtgatgtgaaccgtggtgatgatggtggtggtgatgtgaatcatggcagccgcaatcatcatccttatattttccatcatgatgaggcgcgtttgcgtaatgtgacgaatatccgccgtaatacggcatttgaccgtacggagcaccgccgaaacctgatgcagaaccatcataatgctctgcattttcatgggcctggttttcatattcaccgtaacccgcttgcggcccaaatcccggatgatggaatccgtgatgatggaatccgtacggtaacggcatcggcattaccggaaagcctccataacctcctccaaaaccgccgaaacccccgcctaccgggaagcacggatggcatagtcccgaacccggcagcatcggtgtcaccggaaccggacaaggacaaggcatgcacggcatcgggtaatgcataaaaggcggttcaacggccggcatattcggaaacgggacattcggaatgtttggcatgttcggcagatgataagcggcgttttcttcttccatcttaccggcttcaggcgccttcggcatattcgggtaattcgcgttttccatgttgatcatttcctcctgttgtggaatgttattgtcatgctctttttctttcggctcgacaaaatgtgtcaccggttcctccggcttaggaggcgaccacggctgaaacagctgattggacggataatattggttcatatcagcttccggcagcacattttcatgcttttcagggattggcggcacatacggaattgacggctttggttcttccggtatggtgtcttcaatgtccacaactgatttcggtttttctttggcatatggatgctcatgcttatgcgcagacgttccgaagccggccttgggttcttttctgaccggaacggcttctgaaggcacctttatcttcattccaggcataattaagtctggattgctaagctgatgattcagtttttttaactcttcaagatcaactccgtatttttcagctattttccagagcgaatcgcctttttgaacgatatgaattttcaacgttttcccctcctatgcacaaaacgtgaacggtacatttgtcattacaatacgtttcttcacactatatgccggtggactgggcatgatgataaaaaatttgggaaggaggggaaatttttatgattacgtatgactcagcattctgttcaaagcacgaagcgcttctgtccgaaccgcttccggaactttaatgacacccttcggctcgcctttttcaagctgctcaagcgaccacaataaatgcggcaggtcgattctgttcattgtcagacacggacacatatcgggattcaatgattcaatctgtttatccgggtgcgagtgaatgaggcgctgaacaagattcatttccgtgccgatcgcccacttgcttcccggttctgcctgttcaatcgtatcaataatatatttggtagacccgctgtcgtcactgagcgagaccacttcccgcgaacattccggatgaacgataatgcggatgccggaatcccgctgccgcagctgagaaatattttccgctgtaaacttttcgtgtacggagcaatgccctttccaaaggatgactttaatgttttccggatggtcagtaagcaatcggttctgccccgggtcccatacagccatttctgtcagcggaatgccgaggtcataggccgtatttctgcctaaatgctgatccggcaaaaataaaattctttctttttgtttaaaagcccatttcagcacactccgggcattcgaagaggtgacggtcgctcctccgtgccgtccgacgaatgctttaatttccgccgtcgagttaacatatgttaacggaatgatggtgttaccgtacagttcttgaagctcttgccatgctttgtccgtctgctgaatatctgccatatcagccatcgagcatccggcgcgcatgtcgggcaaaatgacagtttggttatcatcagtcagcatatcagcggtttccgccataaaatgcacgccgcaaaacacaatatattccgcctctttatttttttctgccacttgagcaagctgcagggagtcacctgccgtatcggcgaattgtatcacttcgtctttttgatagtgatgccccggaatgaataagcgctttccgaaagcccgtttaatggcggcgacacgcttttccatttctccggtgctcatgtctttataatggctcggcatcatttcggctgatgcagttagcacgtcaaaaatagacatcttaaaaatccccctgttccgcagcctcaacatccatgctgatgtcggcgctttttactgaatgagtcagaaatccgagtgaaatatattggacgcccgtccctttataagcgggcaatgtatcgagtgttatgcctccggatgcttccgttttgatatgacccggtgtcatgcctgcaaaacgccggacggactcaggcggacagttgtcaaacataataatgtctgcgcccgcttctattgcctcgagcagctgctgttcggattcgatttcgacttccaccgcaagcatctgccccgccgtttttcttgcccgcttaacggctgcctttatcgatccgcaggcggcaatatgattatctttaatcatgatgccgtcatataagccgaagcgatgattaaagccgcctccgatgcgcacagcgtatttttccagcattctgagcccgggtgtcgtttttctcgtatcacaaagcttgatggacggatcatcaagacgccttttggcctcatccgtcatggtcgcaatgcctgacattctttgtatgagattcaaaatgacccgctcccccgtaagaagagctgccgcccggccttccatttcagcgagcacgtctcctcttttcatccgttctccgtcttttttcagggagcggatgcggatatcatcgtgtaaaagcttccatccttcacggataacgtcttctccggcaaacacgccgtctgtttttgcgatgatccgcgctttacattgctgatcagaaaaaatcgcttgtgacgtcgcatcacccgttccgatatcttcctgaaaaaaatgagtcagcatttgtttcagctgcagaatgtccatagttccccaatcctttcgttttttctgataactgttccagatgttgaatgaatgatttgttttccgtgccactctttctccgtcccgggaaaatcagtgcgaaaatgagcgcctctgctttcttcccgaataagggctgaggtcacaacaaattgcgcagtcttccataggcaggatagctcggcttgttccattgtgatatccttcacattcatatgacgcacagatacgttgttaagccaggatgccagcgcctgcaggttttctttttccctgacgatgcccgctccggttgtcattttggcttgaaggacatgaagcgttgtgtccggcacttgtaagatgacatcaattttcttcggggtttttttatatcttccgtttaacggtgtatgaatgatatgttcagcacatcgttgcccgcttgccagcgcttccagcagtgagttgctcgcaaggcggttcgccccgtgcaagcctgtgcaggcggtctcgcctatggcgtacaaatcaggcacggacgttttcccccatgtatcggcttttactccgcccattaaaaaatgcattccgggtgctatggggatcccgctttcaagatcaacgccggctgtttgacaaatttctgttatggtcggaaaacgtttgttaaaatcggctattcggctgcaatttataaaaacaggattttctttcatcatttcttcataaatcgcccgtgaaaccacatcccggggcgccaaatcctcaagcgcgtgtctgccagccatgatcctgcgcccgaagcgatccgctaaatatccgccttctcctctcactgcttcagaaatcagaccgtaaacagtcccgtttttcacaaggagggtcgggtggaattgggtgaactccatatccgtgatctcagcacccgcgcggaaggcaagagcgatgccgtctcccgttatggcggaatcatttgtgtgatattggtacagactgccgcagccgcctgaagcaagcactacacaatccgctcttctgtaagaaacggcgcctgaagcatcctttacggcaacgcctgcgcatcgcccgtgttcaatcagcagatcaacaaccgtctcgtgttcaatgatccgaatgccgtccctcagctgccgaaccagaaactcaaccagcatccgtccggtcgcatctcccccggcgtgcagaatcctccttttggaatgagcgccttccctgccgagacaaaaggttccatccgacttcgtatcaaaagggaaatggccttctatcagcctgtttatcatgctctgtccgcttttcagcaaatgccgcacggctgtcacgtcattgtgtccgcatcccgcatacagtgtatcgttcacatgggattctatagagtcatcttttgcgtatgacacagcaatcccgccttgagcataatgcgaattgctgttcgttacgtttctctttgtaatgacggtcacttggtatgacggaggaaatgaggaagcacaggcaagggccgccgtccccgaaccaatgacgataattgttttttcagacatacatcaccctcctgttatatttacacctgtcttgacacctatatttacacaacgataaaataaactcaagctttttttaacataaacggataggagacgggctgtatgatttatcttgattacgcggcgggaacgcctttaagcaaagaagccgcgaaagtctttcagcatctcagcacagaggtatacggcaatgcaagcagccttcatgacgccggaggaagagcggcggacgtgctggaatattgcagacattctgcaggaaaattgatcggcggagcggcagacggcatttactttacaagcggcggaacggaagcgaacatcttggccgtccaatcgttgctgcacggtctgcccgaccacaaaaaacattttattacgaccgcaatggaacaccactcgatccataatgccgcggcgtttttagctgaccggggaattgatgtcaccatcatatatcccgacgaaaacggccttataaccgaggacatactggcggctcatatccgacctgacacggggctcgtttccatacagcacgccaattcagaaaccggcctcatccagcctgtgaatcgtctggccgcttttcttcaccagagaaacattttgctgcattgcgattgtgtccaaagtttcggcaaactgccgattgatgcggatcaggcgggaatcgacgccctttccgtctccggtcataaagtatacggcccgaaaggcaccggggctgtttacattcggcccggtgtcagctggaatccggtttatccgcataccgtgcatgaaaacgggttcaggcccggtacggtgaatgtgccggccatcggcgcttttaccgctgctgcggagcatgcagtgaaacatatggaggaacaccgtgagcatgctgacaggctgaggaattatttgtatgatcaaattcggcgtcaaggccttcccatttcattttcagaggaagaaaccggcggtgaatgcctgccccacattgtcgggtgtttttttcactcctttgaaggacaatatattatgttagaatgtaatcgtaacgatatttgcatctcaaccgggagcgcatgttccgccggcagccacggcccttcttcagctatgaaggcgctgagaaaaaccgaacgggaagcgcggcagtttttccggatctcattcggaaacgaaacaacatgtgaacagctcgatatgctgatacatacatttacggcgctatgggagcaaaagaaaggagaatcagcaatttgacagaaggaacgaagcttactggggcgaaaagacgcgacatgctgcttcattggctgaaagaagccggctcgccattaacaggaggcgaattggccaaaaaagcaaatgtttcaagacaggtgatcgtgcaggacatatcgctcttgaaagcaaaaagcgaaccgattatcgcgacgagccaaggctatttatacatcagcatgaatgccggcggcgaaaaaaacgccgaacggattgtcgcctgtctgcacggccctgagcggacggaagaagagcttgaactcattgtcgatgaaggcgtcaccataaaggacgtcattattgaacaccccgtatacggcgatttaaccgccgccataagagtcagcacacggaaagaagtcaaacaattcatggatcacattaactcgacaaatgccgcttatctttcacagctgaccggaggcgtgcatctccatacgttaagcgccccgacaaaagagcggattgaccaagcctgccaagcgctggacgacgcgggtattttaataaaagattaaaaaaaagccccctgaagggctttttttatatcgaataggattgatatgttcccagaagcttgacccggcagccgagggcttccatctcttgaacggcaccgggaatgagaacctgatccatcgcctgttcaatatcaataataaagaaatagttgccgagacccgtttttgtcgggcgcgattcgatctttgataaattcaggtttctccatgaaaaagcggacagcaccctgtgcagcgcgcctgattggtcatcttggggaagcgttaccatcatcgtcgttttcggccgtgaagacagtttcgcattcacttcgaatgagacgtctttttcaggcgaaagaatgacaaatctcgtgtggttgtcctgataatcctgaatatcccgcttcacgatgctcaatccgtatgtagcggccgccatttcatttgcaatcacgccgatcggaaggtccgaatgctcactgacatacttggccgccgcacctgttgacttcgcatactcataaggaacggacgaaaaatgccggtgaagaaatttgtggcattgcgcaatcgcatgggaatgagaataaattttctcaagctttttccactcattttctctcgaagggtgaacgagcagatgctggtgaatcggcagcgtcatttcccccacgatcgcaagaggctgctcatgaatcaagtagtcaatcgttaagttaaccgagccctccagcgcgttttccaaaggaacaaatgcaagatcaacttctcccgcaaccgccgcatccatgcatgccggtattgtttgataaggtgcttgtgtcacgctgttttgaaagcaggaactgactgctagatgtgtaaatgtggcttctggccctaaataaccgactttcatgtctcttctctccttacgcgcctgaccctaagatctcaactttttctataaaatcaaattttctcagtttattcattaacgtatgaatgttttcttccattgcggacgtactgattgagagcgtgacattcgccctgccctgaagcggaatcgtctggtgaatggaaagcacgttgcttcctgagtcagccaccgcctgcaaaagctgggataacgcgcctgaccgatcctccaaatgaaagaaaagtgtgattatttgttctttaaccatcgtgtaaaaagggaaaaccgcatctcggtatttataaaaagcgcttctgcttaaatcaactttttgcacggcatctgcaaccgattcagccttttttctgtccagcagttttttgacttcaagggttttccgcatcgcatcaggcagaacgtcttcacgcactaaataaaatgtctcttctttcacctgcacccctcccttttacatcagagagcctgcattgcaagctctccatttttttaatcaataaattcaaattcaaattccagcagccggatgatatcgccgtctttagcaccgcgttctctgagcgcttcatcaacgcccataccgcgcatctgtcttgcaaaacgcttgacggattcgtcacgggagaagtcagtcattttaaagaggcgttccagactgtcacctgaaagcacaaacgcgccgtccggatcacgggtaatgtcaaatggaatttcttcatcttccatcgtgtacattacgcggttttccgccagttcttcttcatcatacagcgggaattcaggcgttgtttccagctggttggcgacttcaaacagaagatcgcggagcccttctctcgtcaccgcgctgatcgggaagacaggatggtcatcctgaagcttttctttaaacgctttaagattttcagccgcttcgggcatgtccattttattcgcaacgataatttgcggacgctccgtcagccgcagattatattcactgagctcctgattaatggtcacataatcctcatacggatcacggccttccatcgctgacatgtcaataacgtgaacgatgacgcgcgtccgttcgatatggcggagaaattggtggcctaagccgactccttcgtgcgctccttcaatcaaaccgggcagatccgccatgacgaagcttcttccgtcatccgtttccaccatgcccagattcggaacaagcgttgtaaaatgataatcggcgattttcggctttgccgatgaaacgacagacagaagcgtagattttccgacgctcggaaagccgacgagacctacgtctgcaagcactttcagttcaagcacgatatagcgctcttttccgggttctccgtgctctgacagctgcggtgccgggttggccggtgtcgcaaagcgggtatttccgcgtccgccgcgtccgccttttgcgatgacggcgcgctgcccgtgctctgtcagatcggcaatgacctgttttgtatcgtcatccgttacgactgtgccgggcggaactttaacaaccatatcgtccgcatttctgccgtgctggtttttagacatgccgtgctcgccgcgtatcgctttgaaatggcgctggtaccggaagtccataagcgtgcgcagtccttcatcaacctcaaaaacgacgtcgcctccattacctccgtcaccgccggcaggcccgcctttcggcacatatttttcacggcggaacgcaaccattccgttaccgccgtcgccgccttttacatatactttcacctgatctacaaacataatatcctccgttctaaaccgtaaaaaaccgctagttcattccaatttcggccacacattcatggccggtcagctcaaattgcatgacatcaaagtcctcataccgcgatttgcgaaattcatcaaacacatctgcatttgcaatcgttccatgaaaatcgagatatacaataagctgtctgtcagggtgatctgtctgcagcgatacggtcagatgattttcactttcattgcttaccgccagaccgaacagatgaaacagttttctcatcaggttcgacagcttttgatcatatgccgataaatctttaatttctccgagcacttcgtattcgagcctcatataacgggacttccaattaaatgtcagaaagtcaaacgccaagtgcggggttttcaggtttgagagctttgattcgtgctttgcatctatgaccatttcgtcaataatttcaacgaccctgtcatacttctgcaaacttaagtttccttttatcagctgcagcttattcatccaatcatgacggaaatggcccattaattggatcagttcattgatcagagccgcatcgcttacaggttcttcttgtttcttcgatacatccttcattttcgcactcccaatcgtttaatttctttttaggagtcttgataagtgtgtactatgaattataacagagaaggctttgttaaaaaaacacttgtttttcctggttcatcatgttcctttttcggatcgcatacaatgcggatgccaggcagaaacatttttggtatcactgcttggggaacatatccagtgggtatgagaagctgatgtcctcattcaaggcggggttcactcacgcatcctctgcttttcattcttgatgttactccgcttactgcaaaaaaaactccagtcaacgaccggagttttttgtgtcattattgagctacaggatatacgctcacttttttgcggtcacggccgaaacgttcgaatttaacagttccgtcgattttagcaaaaagagtgtcatctcctccgcggcccacgttttcacctgggtagattttcgttccgcgttgacggtaaaggatagatccgcctgttacgaattgaccgtctgcacgtttagcgcctaaacgtttagattcagagtcacgtccgttctttgtagaacctacaccttttttagaagcgaaaaactgaagatctaatctaagcatgtaactcacctcctatatttggtttgcagtcaaccgtaagtgttcactgtaatcccgctcgatcgtttcaagagaaacaatcatgccttcaatcagcagctgcgctttttgcaaagcttcctgatcagcggcttcagggaattcaaagtagaaataacccccgtcctcgcctatatcaagaatcggttcgagaggagccagcgcgataaccgcattgaccgctccgaaaacgacagccgtgaccccggcgcaaacgagatctcgtccatgttcagcaaaatcggcatgtcccgtcatttcaaaggacaaaatgcccccgtcatcccgggatcttcgaattgttgcctcaatcatgcttacgcgttgattttttcgattgtcaatttagtataaggctgacgatgaccttgttttttatgaacatttttctttggcttgtaacggaaaacagtgatttttttcgcacggccttgtttttcaactttagctgtaactgtcgcgcctgcaactgttgggttgccgactttcacgctgtctccgccaacaaacaatacgtcttcaaacgtcactgtttcacctgcttcagcagcaagtttttcgatgtaaacagtttgaccttcttcaactttgatttgttttccgcctgttttaatgattgcgtacattctctgcacctcctattagactaagactcgccagcaacagggggctttaaagctcttatcacctgtcccgagcggttgtagcattggtgctacatccataacattaaaaaatatatcagaaccaaaaggatatgtcaatctatttctagtaaggcagcagcaggtcttccatagaggaatctgtccgtttatcggcaaaatacgcatgaagcacttcattttcatcgagctggctgagcttttctccggctttttcaatgataatggggtgcttgcatccccgtttgaattcggccatgacatgctttactttggcatcggccgcgaccgtcaaaggatgcagcatggcgacatcgcggtttttgccgtagtatctctccaaaagaaacctcagctgaatataatgccgcttccggtattcatcccataaagaagcggcgagaaagacgaacagcacccatgcgctgacctgaagggggacggccagcacaatccagcagcagagcaaaagagcggaaacggccgatgtctgcaggctgaggagatgcgctttttgaaaagccatttgtttagagaagtataaaaacacgaacttgccgccgtcaagcggccagatcggcaaaagattgatgaaaagaatggagagattataaaaggtaaacatctcaaatgtctgctcacttgcaaagcctgacatgaaaaagagccaggctgccgcctgaagccacacatgctgaagcgggcccgccaaaatgaccgcgaattcctcttttagcggccggtttccgtgctcctccacctcaaccgtcccgccgaaagggagcagaaagatgcgtttaatgcgccacgaaaaaaacacagccagagcagcatgccccagctcatgaacggatacaaccagcaaaagacacagcagcgctttgatgtgccccgtcataagaccgagccccataataatccaaagaaaaggatggacatgaattttaaaaaggaggatgagccatttattcatcaaatgtgatcacctggatcggatctatgaatttatcgccatcctggatcgcgaaatagtactggcctttacttttatcgttgagcttgatcgaaccgatctttttccctttatcgacaaagtcgtacaatgaaacgttaacatcttttagccggccgtaaatgctgcttgtattgtcggcgtgctgcaccttcaccgtcagccctgtttttttatctttgctcacttccataatgtagccttcttttacactgtcaatggcttcactggcggtttcgacgacgacgccctctccgttattttgaaagtcctgctggattttccccgcggcaggaacggccatatcctgactgaccgccacctgaccgtccttctttttcgttcccggcgtaagaaaagcgagcgggtttccgaaggaagatacgaaccaattgcttacggcagcaaactgaaattctttttgaaaggtttgtgcgattgccggtttgatctgactcagcggctgtttgtcagttttataggcaatagcggagatcagtacgagacaggcggccagcaggcattttaaaataatagaatgagcgctgatcaatggatgccgcccgttaaattcgggcgggtgttccgtttgatattcgtagtccggaagaagcttgtgcttttcctgctccttgaccgtctgccacgcgggaaaattctgcgtttgagcgttttgaacgaaagtccgttttgattcaggccgctgttttcttcttttggccagtctttttctaatttcatcagctctgtgactcatcgccatcatcctttgcaatcgttgggtttgtacatcctatgtcttgtccattgcaaatatgcgctcttaaaaaacaaaaaagacctgataagctgggcttcatcagatctttgtattctggtatatattatgaacgcacgccgaaaaatgacttgattttcgccatcatccctttttgctgctcttcaagcacctgcaaaggaacggattctcctaaaatgcgccgggcgatattgcggtacgcaatgctggcgcggtttttggaattcatggcaatcggttcgccgatatttgaagccctgatcacttcatcatcgtcagcaacgattccgaggagatcaatagacagatgatgaacaacttcatctacatccatcgtgtcaccgtttttcaccaggtgatttctgatgcggttcacgataaggcgcggcggttcgatatcttcctgctccaaaagtccgataatgcggtcagcgtcccgcaccgctgatatttccggcgtcgtcacaacaatcgccttatcagctccggagacggcatttttatagccttgttcaattccggccggacaatcaataatgacataatcaaattcctgcttaagctcctgcacaagcaatttgatctgctcagggacaacagccgtcttgtcgcttgtctgggcagccggcattaaatgtagcagatcatcaaaacgtttgtctttgacaagcgcctgatgcgtcttgcatctgccttcaattacatctactaagtcgtaaataattctgttttcaagacccattacgacatcaaggttgcgcagtccgatatctgtgtctaccaaacagacgcgcttccctaaaatggctaaggcggtaccgaggtttgcagatgttgttgttttacctactccgccttttcccgaagttattacgatagcctcacccaatttcacattcctccctcaagccttgttagatcaggtcttaaatgagccaattgctgaaggcgttcaatgaccatatttccgtcagtatctaaataagcacattccatgtcgttccctttttgaatgtggtctggggagcgatttaacacgtgattgatcctcaattgtgtcggcatcatttcggatgcggcgatcacagcccggttatttccgttataacccgcgtgggcaatcccttttaatgaaccgagaacaaatatatttcctccggctctgatcgtaccgccgggattcacatctccgattaaaagcaaatctcccgtcacgtgaagcacctggcccgaacggacgattttggaaaccgaaacaatttcctgctcctctttcatccgctgcgcttcttctttggcgatgacttcactgtcaattgaatgcacgactaaatctttctttgacgcgatcagatcagtcagctgctctgcctgttcctgatacagataccgatgcccgagtttaatatgaacactgattttttggcctttgccatcagtatattgttcaatcgacagcatgttttgaagaccatcgaggagctcatcaaaagaacacgcatcatccagatgcaatgttaagccgttttttgttccttttattgttacatattgctgctttttggtcttcatcaatgttcacctcaacaacatactcttttcgtcaaaaaaagataaaatcctttttactcatctcttaattctttcttcagacttatataaaacagcctgaagggcaggactaatataacggctcccgcaatattcagcaaagcggtcggcaagaaccgctgaatgacaaaatcgttaaacgtcatagtgccgctgcggattaacgtctgaatgccgtagacgtaaaattcaagcacacatacgctcagcaccgcgaccagaatgaccatcagggcgtttgtctgcagcactttaaacgctttggccgccagatagcataatccggcaaaaccaaacatataaacgcctaaaacacccgtataattgatgtcataaagaaatccgaaaatgaaaccgtagatcaccgcatgcttttggttgatataagccgacataaaaatcagcgcaagcaaaagaaaatgcggaacgacctgctgctcgacggaaacgaaaggaaaacgcaccagatcggtatagatgctttccgcacaaaagaccaaaatcataatcaaagggagaaggaaacgtttcacgatccttcctcccctgttgctacgcttcggttcacgacgatgacatggtcaagatcgtacaagtcggcagccggtttcacgtaagcgattttcgtcaggccgtaagcatctgattctacatcggtcacttcgccgaccgtcagcccttgaggaaatacgccgcccgttccggaggtctccacgaggtcgcctttcttcacttcacgtttttcatccggttcaaggatggtcattttcagggtctgtttctttttatcatacccttcaattaaaccgtagcctttgcttccctttttgccggagattttggtggccactctgttattgcggtcaacatcgctcagcagctgaacggcggatgtgaaactgttgagtccgctgcttttgatcttcccgaccagcgcacccttttcgttcgtgacagccatgtctttggccactttatgcttcgttcccttattgatcatgatctgcttgtaccattgatcagggtttctcgcgataacggtcgctaaaatcggatcatagtcggaaattgatttgacatgcccgagttcatcacgcagcttcttgttttcatctttgagttcttggagcttcgcttcatattgtgtctgtccgtccagcttttgtcttaagcgttcgttttctttgtacgtgtttttcaggtcttttatgtccccgaagaaccctgcaaaatattcggcaggcgtgtgaaaaatgttttgaaatactcccgtcgtatcaccgatcagcttttcaggccaggtggtattacggccgttcttcagcgagaatccaatcatagccaccaatatgataatacacagaagtaatagcattaaccgtttgttcggcatcgtgatacacctcttctatttaactcctgattatcttgtttttcctttgaaaagatggatgtgctccagtgcttttccagtgccgatcgcaacacaatccagcggatcttcagcgataagaacaggcattttcgtttcgtcgctgatgactttgtcgagattgcggagcagggcgcctccccctgttaatacaatacctctgtccataatgtcagcggccagctcaggcggtgttttttcaagcgtgctcttcaccgcatcaacgattgagagaactgtatcacgcagtgcatttgcaatttccgttcccgtgatttcgatcgttttcggcagacctgtcagaagatcgcggccgcggatttccattgacgcattttcttcaccggtttcggctgaaccgatttccattttaatggcttccgccgtacggtcaccgatcatcagattatatgtttttctgatatagctgatgattgagtcgtccatttcgtcaccggctacgcggattgactgggacgtgacaatgccgcctaaagaaatgatcgccacttcagttgttccgccgccgatatcaacgaccatgctgcccgtcggctcccataccggaagattcgcgccgattgcggccgcaaacggttcttcaatcggataagcgtcacgtgcgcccgcttgtcttgtcgcgtcaatgaccgcccgttcttcaacggccgtaatacctgacggcacacacaccataacgtacggctttctcgcaaacaatcctttatttttcacagcctgattaatgtagtatttcatcattgtcgcagttgtttcatagtcagcgataacgccgtctttcatcggacggagcgcaaccacgttgcccggagttcttccgatcatgtttttcgcatcgttaccgaccgcaacgattgacttcgtatccgtttgcagagcaacgacagacggctctctcactacgattcctttacctttaacaaacacaagcgtattcgcggttcccaaatctataccaaggtctcttgtaccaattccgaacatatgtatgtatcttcctttcttaaagcaaaaataccctaaagggaaaaactcataaaatctattatatcttaaatcaacgaaaaaaaaagtgttacaaatatcctttttcctttaaactcacaaattttttatcaccaatgaccaaatgatccagcagctcgatgccgattaaatttccgcactcaaaaagccgcctggttacctctatatcttccctgctcggtgtaggatctcctgaaggatgattatgaacgcaaatgaaggacgcggcggatcgtttgaaagcttctttaaacacctcccgcgggtggacaatagatgaattcagacttccgataaaaacggtgcgtttatgaatgacttgatttttggtatttaaatataaacagacaaaatgctcctgggataaaaagcgcatatcctccatcacatacttcgccccgtcttccggagagcggatgacgcaatgctccccggcggatgtcttatgaatgcggctccccagctcaattgcggcaagaatctgaacggctttcaccgtgccgattcccggaatgctggaaagctcctgggcagaggcgccttttaacaggcgcagcccgtcaaacgtccgcagcagccggtgagcgaggttcatgacggactcatgtttcgttcccgtccgcagcaggatggcgagcaattcattgttagagagatgttcggctccgaagtgcagaagccgctctctcggtttttctttttcggggaaatctcttaattttaacggcagatcacggatgatcaacccctccttgttccccttcccggtttgaacatcaagcttttatattaaattctttcaaggctctcattgttttagcgacaggaagcccgacgacagaataaaaatcaccgtctatttttttcactaaaagcgcgccttttccttggatgccgtatgcacctgctttatccatcggttcttttgtttcaatgtagagctgtatgtcgtcttcactgagcggccaaaacgtcacttccgtcgtgtcacagaatgtttctttccggtcatgcgtctgaatgctgaccgccgtaatgacttgatggcttcggccggaaagcctccgcagcatctgtgccgcttcttccctgtcacgcggtttgccgaggcactcgccgtctatgcacaccatcgtgtcagccccgataacgactgcatcgggattttcggccaatacagcaccggctttttgctcggccaaacattggacgttttcttccggcgaaaggtttcgatttaatttttcttctgtgcggctcgcaataatgctgtaaggaatctgaagaagattaaggagttcttttcttcgcggagattgtgatgcgagtattaagcgttttgtcatggttgtcatcctttcagggtttgcttaagaaaaaaagatacttgtctatcctaccaaatcaaacgggcaaccacaatttcagaaaaataactttttgatgacaaaataaaaaatcccgccggatgacgggaaatgagatactattttacaacacttaaaagctctttttgggctttccagccggattccgaacccgacgtttccagttctttcagcgcttgaagcacggcctctttctgctttttgtcagcggcgtctgcgccgtctgccgcttttgccgcttcagccacttccgtttttgaaagatctttaccggtaatcgctttggcggagagctcagatgcctgtttaaaagagtcttccagccctgaatcgaccgcaaagctgagctcttttccgccccaagcctcaaaatcatggtctatcagtgtctgacccaattgctgtgataagcttttttccgctgcaagcccggcgatcacgtatgtgtatccgtcttcttttgccagagagacggccgagtatcctttttcagtcagctggtcaacaagcgtttgcgctcctttttctgatgaaaattttccggcctgcaccgcatatgttttatagtttcccactgaagattccgcatctcctgtgccggctgtttcagatttgtctttagaaacatctcccgctttcaccgtctgcccttgtgaacctttgtcagctgatgccggagcggaggcttctttacttcccgacatatttaaggcgacaaggccgagcccggtgcctaaaacagccgcaacggcaattgtcgtgaccgcttttttaactggagaagacggctgcttttttttcggaaaatgagggcctgtttttttcttctggtatggcggaacgactttcgggtcatcttcaaatacctcagaattcttctcatgatcccaattgaaatcttcttctttcggatcttcatgggaagcggcggtctcctgttccgccttttttgtttcttcccaattggaaaatgtgacggtcttctccccgccttcattcacatcttcttgtccatacatcgtttcttcttgtccgttaatggttactttaagggcattgtttttagctttgctgtgctttttgctcttcctttttttcaacgtctcttcccccttgcattcgtcttggccgtaccttgaactgatcatggttcacactttagcataggcgaaaaaaaaaagaacaagacttttgtcgtcttgtccaaaaaacgttcgccaaatttttcaagccccgcctgaagcgagcttgatgtaaaacgaaaacagctcttctccgtataaataactcaaagcgctcccggctgagatggccggcgcaaacggaaatggctgctttttaccaagcctgccccgggctgcggcgcacataccgtatacggctccgatcataacggaaagaaagaatgcaatgagcacgagcttcacgccgagcgtcaggccgatcaccccaaacagtttcacatcacctgcgccgatgcctcctttactgacaaacatgataaaaacaagcagagcaaatccacaaacagctcctgcaaaccccgcataccatgaatccagcggagaaaacatacggccggcgatgaaaagcggaagaaaaaacagcagaaccttgtcaggaatcagcatatattgcagatccgtcacagtaacaatcatcagcagagacagaaataacagcgcaactaacagttcttttgagaaaccgaaatgaatgcctgcagccgtgaataaacacgccgtccagcattccgccgccggatacataaccgacagcttcgcacggcagtttctgcatctgcctctttgcagaatataggagacgacgggcacaagctccccccaggagagcggcaagccgcagaacgagcaggctgaacgcggcgaaataaccgagattcgaagcgggatacggcacgctgctgtataaaaaaaagaaccgaaaatcaagccgagaaaaaacagaatcaaaagcactcagaccacacctttactatcaatctggctcagattatagcaaagaaaaacaccatgactgaaatggctgaaaatatattttcagcataaaaacacccggcaaaaccggaaaatggtctgccgggcatccgaggggctgtcagataagccgctttctcatttctgaaataaaatataaggagccggtaatgatgatgacatcatccgccccgtctttttgttctatccattctttcacactgtccgggttctcatcgaagctcttagacgcaagactgcttgcattgtaaagagcttcggcgcttgaagcacgcggaaagtcaaatgatacaaagtgaatggaatctgcttcggtttcaagctttttaatcatttcctgatacggtttgtcttttaatgcgctgaatacgacatggacgtttttatcggcaaagcgctgcctgatcgtttctgtcagcgtttcaacgccctcttcgttatgcgcgccgtccgcaaacactaaagggcggctttgaagacgttcaaaccggcccggccaggaagcttttttcaggccgtttcgcatcgcttcttctgaaatgactgcggcttccaggcgattcagccattcagccgccaatatcgccaatgccgcattctgcctttggtgaatgccgatcagcgacgtttgaatgttttcatagcatttcgtttctgtttccagcgaaaagctttcgccggacggaagcgccgcttcattaaacagtctgcacgttttatatagtgactgatacggagcctgctttttttcggcttccgcttcaataacgccgagtgcttccggctgattgacacccgtaatgaccggaatggaatttttaatgataccggctttctgcccggcgatctcctcgatggtattgcctaaaatggccatatggtcatgtccgatacttgtaatgaccgacaggagcggtttcacaatattggttgaatcaaatgtgccgccgagccccgcttcaaaaataacaaaatcgatatcagcccgcttcgcaaaatataaaaatgcacacgctgtaatgatttcaaattctgtcaccgttccggcatcagtcttatcgagctcatcgactatcggctttatgtcattaacgagcgttctccattcctcatcggtaatcggcgtgccgttgacgctgatacgctcattaaacgtaatcatgtaaggcgatgtgaacgtgccgaccgtataaccggcttcttgaagcacggaacggataaaagagacggttgatcctttgccgtttgtgcccgccacatgaatggcgcgaatgttcttttccgggtgttccagtttttccatcagcttttccatacggagaaggcccggcttaacgccgaacttgagtctgccgtgaatccagctgatcgcttctttgtacgtattaaacaatgaaatcccctcttttatacgacaaggcggtttcttaggaaaccgccccgctgttttatcagcctttcagctctgcaatccgctgccggacagcttcgcgttttgccgtgtagtctttctcttttccgcgttcttcttcaatgacatgctcaggagcttttttaatgaatccttcgttgccgagttttttctgaacgcgttcgacttcttttgtcagcttgtcgaattctttttgcagacgggcgatctcctcatcaatgttaatcagcccttcaagcggcagaatgacttccgctccggtgacgacagctgtcatcgctttgtctgccgcagcgatatccgtcccgattttcagcgtgctcggattcgtaaagcgttcaacgtaagaacggttcttctcaaggcggccggcaatgtcttcggtagatgttttaatgtaaagttcaacctgcttgctcatcggcgtgttgacttcgctccggatattgcggacagaacggattaattcaacgagcagtttcatatccgccgctgcctctttatccgtatgttccgacaccggaaccggccaagagctgatcgtgattgactcgccttcatgaggaaggtgctgccagatttcttccgttaagaatggcataaacgggtgaagaagacgcatcgtctggtcaagcacgtatgccagaacagaccgggttgttttcttcgccgcttcatcttccccgtacagcggaagcttcgccatttcgatataccagtcgcacacatcgtcccagataaagttgtacaggtggcgtccgacttcaccgaattcataacgatccgcaagctgcgttacgtcttctatcgtttcattcagtcttgtgaggatccacttatcagcaactgatttttcaccggacagatcaagctcgtcatacgtcatgccgtccatgttcattaaggcaaaacgggaggcgttccaaattttatttgcgaaattccatgtggattccactttttcatagctgaaacggagatcctgtcccggtgaacttccggttgccaggaaatagcgcagggaatccgctccgtacttgtcgatgacatccatcgggtccacgccgttcccaagggatttactcatttttctgccctgctcgtcacggattaagccgtgaatcagcacgtctttgaacggacgctcgccggtaaactcaagaccttggaaaatcatccgggatacccagaagaaaatgatgtcatatcccgttacaagaacatcggttgagtaataccgcttaaagtcttcagcgttttcatcaggccagcccattgtagaaaacggccaaagcgcggagctgaaccatgtatcaagcacgtctgaatcctgttcccaattttcgctgtcctcaggcgcctcaaggccgacgtacacttcttttgtttctttatgataccaagccgggatgcggtggccccaccacagctgacgggaaatacaccaatcacggatattttccatccagtgcaggtacgttttctcgaaccggtcaggaacgaagtgaaccttctcttcttttgcctgaaggtcaaccgcagcatcggccagcggctgcattttgacaaaccattgtgtggacaggtacggctcaacaacagcgccgcttctctcactgtggccgacagaatgcatatggtcttcgattttaaagagaacgccggattcctgaagatctttgacgagttttttgcggcattcaaaccggtccatgccgttatattgcagcgctttttcattcattgttccgtcttcattcatgacgagaatccgctctaaattgtggcggtttccgagttcaaagtcattcgggtcatgggcaggcgtgattttaacggcgcctgatccgaattccatatcaacataatcatcgccgacgatcggaatttcgcggtttgtaatcggcagaatcaccgttttgccgattaagtgcttgtagcgctcatcttcaggatgaactgcgacagccgtgtcgccaagcatcgtttccggacgggtggtcgcgatttcaattgagcctgaaccgtctgctaacgggtagcgcaaatgataaaacgcgccctgtacgtctttgtaaatcacttcaatatcggataaagccgtttttgtggcagggtcccagttgatgatatattcgcctctgtaaatcaagcctttctcgtacaacttgacgaatacttcacgcacggctttgttcagcccttcatcaagagtgaaacgttcgcgtgaataatcgagtccgagtcccatcttggcccattggctgcggatgaaatcagcatactcttctttccacttccacgtttcttctaaaaacttttcacggccgaggtcataacggcttgtgccctgctcgcggagtttcgcttcgacttttgcctgagtggcgatgccggcgtgatccatgcccggaagccagagcacgtcatagccctgcatgcgtttcatacgtgtaacgatatcttgcagcgtcgtatcccacgcatgtccgaggtgcagcctgcccgtcacgttcggcggcggaatgacgacagaatacggctgtttcgtttgatcgccgcccgcttcaaaatattttcctttcagccaaaaatcatagcggcctttttcaatcgcagacggatcatattttgtcggcattgtttgttcgtttgtatccatgataaccctccagcatgtttagaaatggctgagcaactaaaaaagagccttcatcctgataaaggacgaaaagctctttcgcggtaccaccttttttcatgaacagatttgttcatgcacttaaacggataacgggtgcggcccgaatttctctactgtatgttcaagaaattatgctcccgggcgaccttccaatgagacggcataagaagcctttcagcacagtagcttctctctcttcatgcgtctttcttgtactcttcccgttcaaagcaggtgtatttatatcagctcatgatcttatttattatgttctttattatagtaaaagtgtttttgattcgtcaatcatcttttccaaaaaccgctgccgtcatacataaatgggcatgcaccccgctcttccccttacatacgatacatagaaaggcgaatgtgaggaggaattgcccgtgagaaaaaaattcaattcttattcgctcccccagtgggccagacaggtccgccttgtatccgtgcaagtcattatcccgattacgatctttcaggggatcaggacgattttctttccgacgacttttgatgtcctgctgcttgccatcctgctgtttttagcgtgcgccctgcatttggattggatataaaaaaacgagtcccgttatgaagaggactcgttttccgcttttatttttttctcccgctcaatctgatgaaccttcatgagaaaaggttcaacatttttcatctgccaaaacgctcttaataattgcgtgcactcttctttttcagagcccctttggccggtctgataccgtttcagcactttgtacatggcggacggataagccatatagctgagaaacaggctgatttccgcttcacggagcgggaatgatttgtgatacgtataaaaccagtccaggcattctggacatgctttcggatagcttctgaacattctggagtaaaagccgagcaggtcattttgcggaggacccagcgcagctttctcgaaattcgtgaaaaagcccgatcccgcatcattatacagaaagtggcggctcgataaactgccgtggttgatcaccgctctcgtcttgtcatgatcctttgccgcgtcaaaccattcttccagacgttcgagagcaaaattgacggcggaaaccgtttctgtaagatacgtaacagcctgcagttcaaaaggtgaaaggtaccactctttttccgcccggtcggcgaattgttcatagacaagtttatcattttcccaatctcttttcgttgcttcataaaagcggctgatatcttcagtccggatttggatgtcccgcacagtcgcagaatggagcttcgcgacctctttaaaaaggtaaacatgtttttggtcccgttcttcttcctgatcgtactgaagccaaggcattaaataataagaattctccgtctgtcttcccgcaaaaaaatcgcctgcatacgtgcggcagatcggcacaaatgatcggtagcctttctcctcaatctcaatcataagatccgtaaattcactgctgcgggccggcttgagctgtttcaaagcaaaaatgccgtagtttgagtagaccttccaaacatgcgggctgacaggctcaatgtactcagccgtcagcccgtattcctgaagcactgattggactgcttccattccattcaccacatttttacggcctctttgtgcttacacatggctgttattatattcaggtatatacagaagctgaccttcctcaagctcgtcatcaaacgataaagcattcgttcggatgagctgctgggatgtaatgtcatatcgttcacacacccggtcgattgtatcttgctgctgcacgatacaaattttcattcttgaaaacttttcttcttcccttgtaaataattttgtcaagtaatgagagttgtcattttccttctgctcggttcccggtgccgcttcttcattctttctttcaggcttaagcggctcaggctgttccgcttgcgccggctcctccggcggcagtttggaaaactgaaaagacaaatcgagaggcttcccggtttcctcctccggcggcgccatcttccttacctcaatttcaaacccttcttcatcatgagcctcttcttcaagcagcttaggagcgctgtaaaactcctcttcctgccgttccggaacgaactcacgataaacgggcgcctgctcttcttgaaaaaccgcaggctcatcttcgtcttctgccgccttatgatcgctctgacggagaagcggctcggcctctggctgttcttctttttgaaggaagggctgttccgcaatttttgttttttctgcatgcggagtcagagtgaatgcagggaaaaccggttcgatatcatcttttggctcttcctgcgcttctgctgaatcatcctcaaatacgggttcattcctcacggctgacatgattgcaggctcctcagcttcttccggttcttcttcgtgctgaaaggaaacgggaggaggaggctcagtaaaggaaacaggtttcggcacctcttcttgctccctcagaatcggggcagtttcctgctcttcttcctgctccctcagaatcgggactgcttcctgctcttcttcccgctccctcataatcggggctgcttcctgctcttcttcccactcccccagaatcgggactgcttcctgctcttcttcctgctccctcagaatcgggactgcttcctgctcttcttcttgctcactcaaaatcggggcagtttcctgctcttcttcccgctccctcagaatcggggctgcttcctgctcttcttcttcccgctccctcagaatcggggctgcttcctgctcttcttcttcccgctccctcagaatcggggctgttttctgctcttcttccttccgctccctcagaatcggagctgcttcctgctcttcttcctgctccctcagaatcggggctgcttcctgctcttcttctccccgctccctcagaatcggggctgcttcctgctcttcttcccgctccctcagaatcggagctgctttctgctcttcttcctgctgcctgagtaaaggcgggatttcttcctcgtttttctcagtttcttgtgctgcttcttctgatacagtcaaaggtatttcaggctcatggcgtatcattaattctggttcattttcgtcctctgaatgatgtccggcaagattgatcatttcttctctggcaaattcaggcgccacgtacaaagggatctccggctcttttggctcggattcctcaagcagcccttcaattgccaaatcagcttgaatggttaagatccttgaatccgtcagctgataatcaaaggcatcaataaatacgaaaacatcattgaggtggctcactttatttttcggaatcgtgatgtccaccgggaaacaatgaatgagctcggccgtgccatcctccctcgccctcacttcctctacatgcctcagctcactattaagctcttcaaaatgactgctgtgatctatgttgtactcgccagtaagttctaatgatcctttaattgagacataatcatttacttcctgcaccctgatgtcagggtctaatgaaatcgaaagtaattcagaaacttcctgtcctttttggaaacagattgattcttcaacagaaaattgcaatcggtgattatgcggcaagttcatatcctcctttcatctaatccatacaattagatgtcactaaaggtgtatgccgcaatccgggaaaatatgataatggaagcattgaaaaaagccgatacaagtcttgcttgcatcggcttttcggtatcagcggctgatcgcctggaacactttctcagcggcttgaatggtattttcaatatcctccattgtatgcgcagtggagagaaacaatccttcaaattgagacggcggcagaaatacgcctgcgtcggccatccctttataatacttggcgaacagctttaaatcagaagatttggctgattcatagttaatgacaggctcattggtgaaaaagaagccgatcattgaccccgcccggttaaacgtgtgcggaatgccatgtgctgcagctgcttttgaaatgccttcttcaagcatatcgccttttttcacaaattcttggtaagattcaggtgtgagctgctgtaacgtctcaagtcccgctgtcatggcaagcggatttcctgacaatgttcccgcctggtagatcggaccgctcggcgcgattcgttccatgatttcggctttgccgccatacgcaccgacaggaagaccgccgccgatgactttgccgagacacgttaaatcaggcgtcacgccgaaatatccttgcgcacagttatagtccacgcgaaaaccggtcatgacctcatcaaaaatgagcagcgcgccatactgttccgtaatgtcgcgaagtccttgtaaaaagccttcctgcggcggaacaacgcccatattgcccgctaccggttcaacaatgaccccggcaatatcttcaccgtactcccggaatgcgagtgcaacgctttccaagtcgttgtatggaacggtaatcgtattcatcgctattccttccggcacgcccgggctgtccggcaggccgagtgtcgccactccggatcccgctttgatcagcagcgaatcaccatggccgtggtaacagccttcaaatttcaaaattttgttgcggccggtatatcctcttgccagacgcagggcgctcattgtcgcctctgtgccggagctgaccatccgcacgatttcaacagacggcacacggtcaatgaccaatttggccagttcgttttccacttcagtggatgccccgaaacttgtcccgttctcggctacttttttcaggctttcaacgacccggtcgttcgtgtgacccaaaatgagcggcccccagctcaggacgtagtcgatatattcattgccgtcaatatcaaaaattttcgatccttttccgcgctgcataaagatcgggtccatatcaactgatttaaacgcgcgcaccgggctgttcactccgcccggcatcagtttctgcgcttctttaaaagcggcttttgatttttcatagcttctcatctgcctcagctcccgtcaaatgaaatcgttactcagcaagccattttgctgcgtcttttgcatgatacgtcataatcagatcggctcctgcacgtttcatgcccgttaaaatttccagcaccatttctttttctttaatccagccgttttgggctgccgctttcaccatggaatactccccgctcacattatatgcgaccagcggcaggtgatggcggtttttcacatcacgcataatatctaagtatgacatagacggtttgacgattaaaaagtcagcgccttctgccgcgtctgattcagcctcacgtagcgcttccaggcggttggccggatccatctgatatgtttttcggtcaccgaactgcggcgtgctgtcagccgcgtcgcggaacggaccgtaaaattcacttgaatatttcacggcataagacatgatcggaacattcgtgaatccttctttgtcgagcgcttccctgatcactgtgacaaaaccgtccatcatatttgaaggagcgatgatgtcagcgccggctttagcctggctgacggctgtctgcgccagcagttcaagcgactcgtcattcaggattactccgtctttcacgacgccgcaatggccgtgatccgtgtattcacaaagacatgtatcagcgatgacgatcatttcaggataatgctttttaatctcagcaatccctttctgcacaatgccgtggtcgtgaaaagcctgggttccgcaggcgtctttttcttccggcacgccgaaaacgatgaccgacttaatgccgagcgatatcagctcagccatttcatcctttaacaaatcgagtgatacatgataaacccccggcatggaaggaacttctttttttccttcgagtccttcaacgacaaataacgggtaaataaaatctgaagggtgaagacgtgtttcttttactaaatctctcatcgcagcgttcgcgcgcaaacggcggtgtctgttaaatgtttgattcatcattatctatcctttcccgacatgctgcacatgacgtccagcatgccttcaatcgtataggtgtcaggcacatgggatgagatcccgtattccaagagcgctttctctgtcaaagggccgatgctgatatagctcgcaccgctgttttcccacgctttttctccgtctccgaccgcgtgcataaacgtatgcaccgccgatgagctggtaaacgtaataaaatcaaaatgagagcgggatgcagcccgtctcagctcgtccatgcctttttcatcctgaatggtattgtataacacccattcccttatttgatagccaagcggctcaagctccgcttttatgacatcgcgtgataaattgccctttatcactgaaatgggttcggcagctgatgcgtgccgttttaaagtatcagccagacattccgccacatactcgtcaggcatcgcatccgtccgggctccccgctctttcagggcgcgcgcagtcttttcaccgacggctgcgatttttttccgtcccggaagcgcaaggccatgctgatcaaggtaggaaaaaaagaaccggacaccgtttacgcttgtaaacacaagccagcccggttcagaaaggtcttcccgcagactgtccgcacattcatccgggagcgcttcctgaaaagcgatcagagaggcggaaacagccgttccgccgagcgcctccactttttttcggaacggtgctgcctgtcttttgttccgggtgacgagcacggtctttccttgtaaaggaaggtcatttgccatcctgttcgagctcctgtttcacgctgtcgattagtgctttggctcctttttcagacatcatcgccgcacagcgtttcccgatttcttccggatcatgtcccgccgctgtttctttataaatcgtctttccgtccggagacgcgacaagaccgaccaattcaacctcatcccggtcattgacggacgcatacccggctatcggcacttggcagccgccttccatcgcgtgtaagaaagcccgttcggctgccaccgtgcgctgcgtatactcatcggtaaattgcgcaaacagcttcaaaagctcttcatccgactctctgcattcaatggcaagagcgccttggccgaccgcaggcagacagcggtccggttcgaggaattcagatacgacatcatctttccagcccattctcgaaagccccgcagccgctaaaataatagcatcgtaatcttccgtttcaagcttttgaagtctcgtatcgatattgcctctgatccacttaattgtaaggtcagggcgttcagcaagaatctgggcgcttcttcttaaactgctggtgccgatgatgcccccttcttttatgccgtccagcttttgatgcccttttgaaatgagcgcatcacgcggatcctcacgtttcggtatgcagcctatgacaagaccctcaggcaaaacggcgggcatgtctttcatgctgtgaaccgccatatcaatctcctgatgcagcagcgcctgttcaatctctttgacaaacaaacctttgccgcccacttttgacagtgtaacatcgaggatgcggtcgccttttgtgacaatctcccggatttcaaagtcataggaaggattcaattccttcagtttgttaatcacccattttgtctgggtcatagccagtttgctccgtctggaacctaccttaatcgttctcattttctttcctcccgaatctgtttgggcgcgtgcgttaactgaaccaatggaattgtgacaggcttccgagcaggaagtaattaatcatcagcacgagaaaacatgctgaattccataacgccgccacttttccctgcagttccttaatcattctgatatataaatagtagctgtataaaagcagcacaataaacgagccgagcacttttgaatcaaaccagtacagcgtttccagcgacacatacgcccagatcacgcctaatatcaggctcaacagcagcatcggaaccccgatgacatttaaaacgtaagccatataatcaagttttgacaaatcttcaattctcaacagccattttccccattttttcttctttaataaagaatattgaaactgataaagaagcgaaaagacaaaagaaagggaaaaagcgccgtaagacagaatcgccattgtaatatgaatgaccaaaagctctgagaccagctggccggaaaaggcggccgaatgctgatccgtcggtgaaaacgtatggatcgcaatcatcgagaaaccgatgacattcgtgaaaaacacgataaaatcaacccgaagaatctgcgtgaccacaagtgaaagcgtgacaagcacccacgcataaaagtaaagggcctctgtaatattcaagaccggaaatctgcccgtctgccacatgaaataagaaagatagacggtttgcagagtccagacaatagaaagcaaccagaaggctatttttccagccttccggttgtgttgaagaaaatctataaagtaaaaaaggacgcttactgcataaataacaattgtcgcttcattaagtcttgccattgctgtatcaatcatacagccctcactcacttacaagcggacgtaagcccgtttttgcttctgccttttgaaacgaatgaaccgtctggcggttatccaggcttttgtccagctggcggccggcctcttcctcaatatcgaaaatctgcataaacagcttcagcttttcatctgaatccgcttcagccgcaagctctttcgctttcagaatcgggtcgcgcagcatttgattaatgatgcttttcgtatgtttgctgagaagttttttctctcttaccgtcagatgaggcagcttgcgctcaatgctctgcatcgtatcggactggatggacagcgccttttcacgcagcgccgaaatgaccggcacgaccccgagcgtattaagccactgcttaaactcaacaattgccgcttcaataaacagctcgactttttcagcggtttcgcggcgttcttgtaagttggcttcaacgattccttcaaggtcatcaatatcgtacagaaaaacaccttcaagatcattcagcgccggatcgaggtctctcggcacagcgatatccaccataaataacggacggcctttccgctgtctgcccgctctctccatcatctctttagacacgacgaaatcacttgcgcctgtcgaactgattaaaatatcagcttcagcaagtgcatgttcaagctggtttaagctgcgcgcttctccggagaaacggtcagcaagcgcttttgccttcaaaaacgttctgttgatgaccgttactttgccgataccctgaccgtgcaggttttctgcggcgagctcgcccatttttcccgcaccgagaatcaaaatgtgcttatttgacaatgagccgaagatttttttcgcgagttcaacggcggcgtaactgacggaaacggcattggcgccgatatcggtttcggcatgtgtgcgtttgccgacggtcaccgcctgtttaaacagctcattgaaaatggtgccgatcgtcttttctgcctgcgccgttttaaagctcgagcggacctggccgagtatttgcgtctctcctatgaccatggaatccaaaccgcacgccacacggaataaatgctcgatcgccgcgtcgctctcataaaatttcagaaacggagacagctcttctttcggcagcgagaaccattcggataaaaatgtctttatataataacggccggtatgaagctggtcgaccaccgcatatatttcggtgcggttgcaggttgacacgataatgttttcaagaacgcttttttcttcttttaaacggagcatcgcttctgcaagctcatccggctgaaaacttattttttcgcgtatttcaataggggcggatttataatctactcccacaacaagaatatgcatcgctttcatgcacccccgtacatcgcaatttatttataatcattctaacatagaatttattatttataataattataacatagtttcttcgggaaaatgtgaacagatttcaaaaatgttatgctatagtataaaaagctcgtttccactgtaatcatcatactaaaaatcctttactgcgggtaggtgacaggatgaaaaaaacatcaattttattaccgggacttctgcttgccgcttcattattcgcatggcttcagagcggacaggttcacctgtttgcgaatcagggggaatggccggtgctccttatgctcttgggggccgtgctcttgtatcagggcaaaaaggaagcggccgggcctcacgtcctgatcggcatgcttcttttcggcataggtttacactttttcgccaaacctgagctctcatggtggccgggagattttgaaatgattctcttcgtcttcggattctccttatttgcggctgccagaaaagaatatgtatacgaagcggctgccatgattggtttttccctctttttatacttctttaaacaaattacggcgtggctggagtccgtccatattccgacggaacacttcaaaacatactggccgtatgttttcatcggaatcagccttttattattgtttatcaagcggaacaaaactatacgataaaacccaaaacgcactgcgttttgggtttttcattaccggctgatcatttttttaatggctccccatgcttcatctttgccttttttcgtttcagaggaaaataaaatcagctcatcttcaggatccatatcaagcgtctgtttgacaacctttaagtgcttgtcccattttccttttggaatcttatccgcttttgtcgcgataacgatgacgggaatgccgtaatacttcaggaattcatacatgttcacgtcttcagcagacggcgcgtgcctgaggtcgacaatctgcacgcaggctttcagctcttcgcgggtcgtcatataggtttcaatcattctcccccatgcttcacgctcgcttttggaaactttcgcaaatccgtacccgggaacgtcgacaaaatgcaattcatcattgatgatgtaaaagtttaaagtctgtgttttccccggttttgatgacgttctggccaagtttttccgattgattaatgaattgataaaagatgactttcctacatttgatcttcccgccagcgcgatttccggaagccccccatctgggtactgctcaggtttgaccgcgctgatcacgatttctgactttgtgactttcatttcttctctcctactaaggcatgttccaaaacgtcatccaggtgagaaacgaatataaacttcagtccttctctgacgctttctggaatatcctctatatctttttcgttatctttaggggcaataatcgtggtcaggcccgctctgtgcgcgccgagcgccttttctttcagtccgccgatcggaagcacgcggccccgcagcgtgatttctcccgtcataccgacttcgcgttttaccgcacggtccgttaatgctgaaacgagcgccgtggccatcgtaattccggcagaagggccgtctttcggcaccgctccttcagggacatggatatgaatgtcatacttctcatggaatttcgggtcgattccgaactgttccgctttcgaacggacataactgaaagcggcctgcgctgattcccgcatgacatctccaagcttcccggtcagaatcagctttccttttcccggtgacaatgacacttcgattgacagcgtatctccgccgaccgtcgtatacgcgagccccgtgacaaccccgatttgatcttcggtttccgcctgtccgtatctgaatatccgttttccgagatagtcggccagatttttctctgtaaccgtaatgcgttttctctcctcagacacaatggctttcgcagcctttcggcaaatggcggcaatctggcgttcaagcgttctcacgccggcttccctcgtatagtagcggatgatgtccgtaatcgcctgatcccgaatctgcaggctgctctttgtgaggccgtgctctttgatttgtttcggaagcaggtggtctttcacgatctccagcttttcgttttcagtgtagcctgacaggctgataatctccattctgtctctgagagggcccgggatggaagcaaggttattcgcagtcgcgataaacagcactttcgataaatcgaacgtctcttcaatatagtggtcgctgaatgtgctgttttgttccggatccagcacctcaagcatcgccgaagacggatcgcctctgaaatcagacgacattttgtcgatctcgtcgaggagaaagaccggattttgtttgccggcttttttcattccctggataatccggcccggcatcgccccgacgtatgtgcgccggtgcccgcggatttcagactcatcgcgcactccgcccagtgaaattctcacaaaacggcgtcccatgctcgtactgattgattttgcaagagatgttttaccgactcccggaggtccggcgagacaaagaatcggccctttcagcgttttcgtcagctgtttcacggccaaatactccaaaatccgctctttcactttctctaagccgtgatgctctttatctaagatttccccggcttttttaatatcaagtttatcttctgtttcatccgaccacggaagggcgatgagccagtcgatatagttgcggataacagagctttccgctgagcttgacggcactttttcgtaacggcttaattccttaagcgccgtttctttgacacgctcaggcatgcctgcttcttctatcttttccgtgagcgactgaacttcgccggtttttccttctttgtcgccaagctccttctgaatggctttcatctgttcacgcaaatagtattccttttgagtgcgttccatcgaacgtttgacgcgctgaccgatttttttctcaatctccagcacttctttttcattatgaatggaacgaatgaccttattcagacgttctttaatatccgccgtttctaaaatgtcctgcttgtcctttaatttcagcgggagatgagaagcgacgatatccgccattctgccgggctcttcaatatcagtcacagccgcatacgtttctgcggaaatttttttagaaatttttatgtactggtcaaaatggtccagcagcgtccgcataagcgcttcgtcttccacgtcttttgaatcatcctcatgcatcagctgtatatcgaccgaagtataatcttcgagttcggtgtattcaaggatctgcgcccgctgaattccttctacaagcactctgatcgtaccgttgggcagcttcagcatctgtttaatttttgtataagtgccgacggcgaaaatatcctcttcacccggttcgtctatcgaaatatcctgctgagtggctaaaaaaatcatatgatcatgcatcattgcctgttcaagagcctgaaccgacttgtcacggcctacatctaaatgtaaaaccattgtcgggtataccaataagcctcttaaagggaggagcgggatgctgcgttttgtatcttctgccatgtgactgacacctccgtgactttagtatgaaccattataatacaactttttcatcgttgtacaattccgggatcgggctttaatcggcttatccgcctgccctgtatataaaacagtctcttcgtagtataccctttctttctgttctgaaaaaggaaaagatgtcctccataaaaaaaccccattataaaaatggggtttatacagattctttattcatttggatatcaaacggtttttgttctgaaggagggtcaaccaatatgacgtcaagcacttcctgaaacgtttttaccgctttaatggtgattccgtctattcgtttcagaatggactgctgattttcatatgggataatgaccgtttttgctccggcctgttttgcggctttaattttcggaatgacgccgccgatcggtttgacaagccccgtcaggctgatttctcccgtcatcgccaccgtatggtcgatcgggatgcggtgaatcgcggaaaaaatccccgcggccatcgcgatacctgctgaaggtccgtcaatcgggcctccgcccggaaaattgacgtgaatgtcatagtctgaaggtttgatgcccattgtgcggagaaccgtcagaacattttccacagatcccttcgccatgcttttgcggcggatcgacttcgattggctgccgatgctttcttcctctgcaattcccgtgatattcaggcttcctttgtcctgcgccggtgtgacattcacttcgatttccagcaatgcgccgctgttcggcccgtagacggcgagtccgttcacgatgccgacttgcggttcatcggcgattttctgctcatttttaggtgtgagctgactggaatgaacaacccattctatatcttctgtcgtgatttcttttctgtcctcagtcaccgccatgccggcggcgatctggatcatattgacggcttcacgtccgtttctcgtatatgcggtcagcacgctgagagcttcatcagaaatctctttctgaattttgtcggctgctttcttcgcaacgattttaagttcatccttttccagctcgcggaaaaatacttcaagacagcgcgaacggatggccggcggaatttcagtcggcattctcgttgtcgctccgatcaaacggaaatctgccggaagcccattttgaaaaatatcatggatgtgattcggtatttgcgtattttcttcactgtaatacgcactgtctaaaaatacttttcgatcttcaagcaccttcagcattttattcatctgaatcgggtgaagctcgccgatttcatcaataaacaataccccgccgtgcgcatgagtcacagccccctgtttcggctgcggaatgcccgcctggcccatcgcacccgctccctgataaatcggatcatgcactgaaccgataagcggatcggcaatcccccgttcatcaaaccgcgcggtcgtcgcatcaagttcaacaaaaacagcctgcttttgaaacggtgactgtttatgttttttcgcttcttccaataccagccgcgccgcagccgttttaccgactcccggaggaccgtaaataatgacgtgctgcgggttcggtccgcaaagcgctgcttttaacgctttaattccgtcttcctggccgacaatgtcctgaaagcttttcggccgcaccttttctgataaaggttctgataaactgatggcgcgcattttgcgcagctgttccatttccttttttgattctttatctatcgtcactttttgtgttcgctggtttttgagcagattccaaaaatatagtccgatgactatcccgaaaaacagctgtacaaataatgcgatccctgtccaactcatactggtccctcctgaaaaaacgatttatgtatccaattcattcctctgtccgctagtatctcccagcaaagcccggaataaacattttcagaagggtcaggacaagaaaaaaacctcctgatcaaatcgggtcaggaggttttgtcgtgttatgctgatgttttatcttggccgacaacagtgccgtcttttaatacaagacgcggcgcttcaccgtctgcgactgtcgctccggtaatgacacatttttcaatatcatcgcgggacggcagatcaaacatgacgtcaagcatgatgccttcaatgatagaacgcaggccgcgtgcgcctgttttacgctcgatcgcttttttcgcaatttcagataatgcctcgccttcaaattcaagctcgacatcatcaagttctaacattttcttgtattgtttgacgagtgcgtttttcggtttagtcagaatttcaaccagtgccgtttcgtcaagctgctcaaggcttgcaatgacaggaagacggccgatgaattcaggaatcagaccgaaacggagcaagtcttccgggagaactttagaaagcagttcttctttttccaggtctgccgctttattatctgagccgaagccgatgactttttgtccgagacggcgtttgatgatttgttcaatgccgtcaaatgcaccgccgcaaatgaacagaatgttcgtcgtatcgatctggatgaattcctgatgaggatgtttgcgtcctccttgaggcggcacgcttgcaaccgttccttcaagaattttcagcagcgcctgctgaacgccttcgcctgatacgtcgcgtgtaatggacgggttttcagatttccgcgctactttatcgatttcatcgatataaataatgcctttttctgctttttccacatcatagtctgctgcctgaatcagcttgaggaggatgttttctacgtcctcaccgacatatccggcttcagtcagagatgtagcgtccgcgatcgcaaacggaacgttcagaatacgcgcaagcgtctgggcaagaagtgttttcccgcttccagtcggtccgattaaagaaatattacttttagaaagctcaacatcatccactttactgttggaattgatgcgtttgtaatggttgtataccgcaaccgcaagtgatttcttcgcctgatcctgtccgatgacatattcattcagaatctcacggatttcctgcggcttcggaacgtctttaaattcgacttcttcttccgtaccaagctcttcctctacgatttctgtacagagctcaatacattcgtcgcatatatatacacccggtcctgcaaccagcttacgaacctgatcttgcgtttttccgcagaacgagcatttcaattgtcctttttcctcgttgaatttaaacattctttcaccccttaatcttgtctcactttttcttttacctgaagggcaaaagaaaacggttcttgctacgatcgagtatgtattgcattttaccatactttccagtaagacggtaacaatgtgtttcgcacttgcacattctatatgtatgacgaaaaacagcccggcaatgactatcttgccccaagaaaaagagttatatcataattgtacaaaacaaggcacgaattaatcgcgccctgttttattatgtctattattatgaaccatattaacggttttctacaagaaaatcaattgcttttcgaacttttaaatcttctttcatcgcgtcagttgaaccgattgcctgcttgatgttttcaaccggcatgttgtaagcttcagccattttagtcagctcagcttcaacttcttcgtccgttacttcaaggttttctgcttgagcgatcgcttcaagagtcaggtttgattttacgcgttttgcggcatcttctttcatttgctcttttaacgcgttttcgtcttggcctgagaattgagtgtaaagctcaaggttcatgccttgcatttgcagacgctgttcgaattctttcagcatgcggtcaagctcagtgtcgatcatcgcttgaggaacatcagcttcagcattttcagatgctttcagaacaagctcttcacgcaatttagcgtcagcttcgttttcttttgcttcttcaaggcgtttttttgttttctcagttaattcagcaagcgtttcaacttcttcgtcaatgtcttttgcgaattcgtcgttaagctcaggaagctctttcgctttgatttcatgaattttcactttgaaaacagctggttttccggcaagctcttcagcgtggtactcttcagggaatgttacttcaacatccttttcagcgcctgcttcaaggcctgttaactgctcttcgaagcccgggatgaatgaacctgatcctacttcaagtgagtagttctcagcttttccgccttcaaacgcttcgccgtcaacgaaaccttcgaagtcaagaacgactgtatcgccgttttcaacagcgccttcttctttcacgacaagctcagcctgacgctcttgaagcgctttaagttcgttttgtacatcttcgtcagtaacagcagtgtcatctttttcgattcctaagcctttgtaatcgccaagtttcacttccggttttacagtcacttttgcagtgaaaattaagctttcgcctttttcgattttttcaacatcgatttcagggcggtctacaggctcaatgccggcttcttcaaccgctttagggtattctacaggaagtaaaatatctaaagcatcctggtaaagagcttcaacgccgaaacgctgttcgaataaaccgcggggaactttccctttgcggaatccaggaatagaaacctgttttactacttttttaaatgcatcatcaagagctgttttgaacgtatccgcatcaacttcaaccgttaatacgccttcgttgccttcttgtttttcccattttacagacatgtgtttccctccaaaaatctattcaggttgtgtcggtcttccattctaaagcaatccgcggctttgtcaaagaaaaaaccgctttgaatcagaatcattatgtaatgaactggcagcctgtccaaccgtaattctcatttcagttaaaccgctatacataaatacaaccactatattataacataacgcctaccgctttcaactatatggtgtgatttacaaataagaaatttcttcaatatccttaatcatcgtgcaggcttcttcgagttcgcggctgtcaaactcgtacatcatatgaagttcctccggctcaatgtcaatgccgtgcatctcgtaaccgaccttatgaagcgcagccgcccataaatccgcgttcaaaaacttcggcataaaagggtgcaggacgtacagatgccttctccacagctcctcgacggcagcgtataatgtagggttttcattgccgagcgtttcatcaagcacccgaagaacgcgatgcaaaatcggagctgcatcaggctgaaccgtttcactcggaaccgcggtcattgaatcgccgaattttgtaatatgaaccggcttgctgtagtcatgctccgccatcagcgtcaaaatcatcgtcttgataagcggatgcgcgcccggatcttgaagaattgtttttaagagacccgtgtattttgcaatattgcggtctttaagagaatgaatcagattcatttgttcagcggggctgttcagcactttttccgcatcaagaatgtcctcgtattcctcctcccacgcctcatcctgctgatcgggatcggtcattttgcggctgaattcgagcagccggtagaattgctccgcactttctgcgggcagctggttttcttccagcacagcttcaattgtgcttttgacttcttcatattgtttcagctgaattaaaatggtcatgtacacctgcagcacggtgaaataatggccgtacccttcattcagcattttctcgcaaacttgttttgcttcttccaattccccgagttccagaaaacaaatcgccatgcctaaatgtacgtcggactcggtatcgccgtggcttaccgcctctgaaaacagttcgagggcctcctcatactgtttatccttcatggcggccatccctttatcaaccaagcgttctttcagacgggggaaaggaatgatatcagcttttttcttgtcatgcgtcatactttatttcctttcaggcgctattttgttcaagtgtatcaacacgcgtcatgaaacacaagaaaggatgatgcacacggtaaaaaaagctgccggacagatgccgggcagcttttttcaggcttgaagccatgaactccttttcgattcaaactgctgaatgtcgtcctccagcagaagcgttaatgaaatttcatcataaccgttaatcagcatttccttccagtgaggatcgacttcaaatgaaatctcttttccttcactgtcatgaatgagctggttttccaaatcaaccgtcatgttaagagactgattttcatattggccggcgagttttttccactgatcatacggcatacggatgggaagcataccgtttttaaaacagttttgatgaaaaatatcggcaaatgacggagcaatgatgattttgaagccgtaatcatccaacgcccaaggagcgtgttcacgggatgatccgcagccgaaattctctccggcaattaatatggacgcgccttcatagactttacggtttaattcaaattcagggtcaggctcaccgttctcaaggtatctccaatcaaaaaacgcgaatctgccgtatccggttctttcaattcttttcaaaaactgtttcggaataatctggtccgtatcgacgttgatccggtttaagacggccgcttttcccgtatgcgtttttaaaggttccatcttttcgcgcactccttacacaactgttttttcttgataaaactttcttacatcgacgaaatgcccgtgaatggccgccattgccgccatcgccgggctgacaaggtgtgttctcgcgccttttccctgtctgccttcgaagttgcggttggaagtggaagcgcatcgttccccttcaggcacgacatcattattcatactgaggcacatgctgcagcctgattctctccattcaaagccggcctcgagaaacacgcggtgcagcccttcttcctcggcctgctgtttcacgctttgagaacccggcaccacaatggctctgacgctgtcggcgacttttcggcctttgatcatatccgcagcctggcgaagatcggtcatccgcgaatttgtacaggagccgataaacacatgctcgactttaatatcttcaattttttgattcggtgaaattcccatgtattcgtacgcgcggatggcttcttttttaccgtcttcagaatcaatcgtttccggcgccggtatttgggcatcgaccggaagaaccatgccgggattgacgccccatgttaccattggagaaatctcgctgccgtctaacacgatggaatgatcgtatacggcgcccggatcggtttttaacgctttccattctgcggcggctttttcaaattcctcgccttttggcgcgtatttacggtttttacagtattcaatcgtcgtgtcatctggagcgatcagtcccgcccgtgctcccgcttctattgacatattgcagacggtcatgcgttcgtccatagacatgtttctgaatacttccccggtgtattcaatgacatatccggtaccgaatttcaccccgtattttccgatgaccgacaagatgacatccttcgctgtcactcctttttggagcgttccgtcaacgcggatttcaagcgttttcggccgttgctgccataatgtctgtgtggaaagaacatgttccacctcacttgtgccgataccgaaggcaagcgctccgaacgcgccgtgagtcgatgtatggctgtctccgcaaacgatcgtttttcccggaagtgtcagaccaagctcaggcccgactacatgaacgatcccctggtctgcgctgtgaagatccgcaagacggacgccgaactcctcgcaattccgttcaagcgcggttacttggcgctttgcgacttcatctttaatgtcaaaacggttgacggtcggaatattgtggtccatcgtcgcgaatgtgttctgcggccgtctgacctttcttcccttctgccttaacccttcaaacgcctgaggagacgtcacctcatgaatgaggtgcagatcaatatagagaaggtcgggttttccttcaccgctttttacaacatgccgatcccaaatcttttcgatgattgttcgaggcatcatctttgtttcctccctctacctatgaactaagaccgctttaaagcgtcatactatagattttgtattcgagccggctaatgcggcttttactttttcagtaatgtcatgcgttccggcatattggccgtcccgggcgatatcacgtgtacggctgccgtctgcaagcacctttgcgaccgctttttccaccgcctgcgcttcgttttcaagtccgaaagatgttctcaaaagcatcgccgctgataaaatcgccgcaaacggattggccatccctttaccggcgatgtcaggcgcagatccatgcacgggttcaaacaagtgaagacctgaacttgataaactggctgacggcagcatgccgagcgagcctgtcagcatggaggcttcatcgcttaaaatatcgccgaacatattctcagttacgatgacgtcaaactggctcggagcgtagatgagctgcatcgcggcattatcgacaagcatatgttcaagcgtcacatcaggaaattcttttgcgatttcatctgccgtttcacgccacagtctgcttgaagaaagcacattcgccttatcaacggacgtcacttttccttttctgccggcagccatcttaaaggcttctctgacaacgcgtgcgatttcttctttcttataaaaaagggtatcgaccgcttccttttctcccgcttcattgacatactgcctgctcggttctccgaagtagaggccgcccgtcagttccctgacgattacaaagtcgacgccgctgatatattcttttttcagcggagacgcctcagacaagctttcaaatacggtcacgggacgcagattggcaaacaggccgagtttttttctgatgccgagcaggcctttttccggtctgagctccggaggattttggtcccatttcggtccgccgactgccccgagcaggatggcgtcggatctttcacaaagagccaccgtctcctcaggaagggggttttgatgggcgtcaatggccgctcccccgatcagtccgttttcaaattcaaattcatgtccgaattgttcggcaacgcttttcaatacatctgccgctgattccgccacttccggtccgattccgtcaccgggaagcaaagcaatgcgttttttcaaatcaaacgttctcctttctattacgagccgaccgcagtctgtctctttaatccgtctaaattgcaatccagcaccaactgccggttcacggcgttcagataagctttagcagaagcttccagaacatcctgcgcgattccccgccctgatgtttcttttccgttcacggtcactctgacgtaaacttgagccagcgcgtcttcgcctttccggttggattggatgcggtagtctgtcagttcaatatttttatcgatgcagcgcccgagcgtattataaacggcttctacgctgcccgcccccgttgcggcctcttgcatcagctgttcgttttcctgatttttcaaagagactgttgcagtcggcacctgagacgtcccgtaatgcacttgcagagacaaaaattcatagccgatttttttgtccgtcactttttcttctaaaataagagaaatcaagtcatcatcggtgatttcttttttcttttcggtcagttctttaaacatcgtaaaaaatttattgatttcctcactatcaaactggaatccaagcgcattcaggcggtctttgaacgcatggcgtccggaatgctttccgagtacgagcgcatcagcagtcacgccgacaagttccggtgaaatgatttcatatgttgatttttctttcaggaaaccgtcttggtgaatgccggattcatgtgcgaaagcgttatctccgacgattgctttattgcggggaacggccatgcccgtcagtttgctgacaagatcactcgtccgcttcaattcatgaagattgagagatgaatcggcttgatgcgcgtcatttctgacatgaagcgcaacggcgatttcctctagcgcggcgttcccggctctttctcctatgccgttaatggcgcattcaatttgatcagcgccgttctcaattgccgaaagtgagttggcaaccgccattccgagatcatcgtggcaatgggctgagagctttacccggctgatattcggaacgtgttccttcatatatttaaagatgtttccgtattcagccggcgtcaggtaacctacagtgtccggcaggttgatgacgctcgcgccggcatcaatcactttttccacgatttcagccagaaacggaagttcggtgcggcatgcgtcttctgccgaccattgaacgatcggaaagcgttcttttgcatacttcaccatttcaaccgcttttttcttaacctcttcccgcgtcattttcagcttatgcttcagatgaatgtcagaggtggcgataaagatgtgaatgcgcgggctggccccgtctttcagcgcttcccaggctgcgtcgatatcacctttgacagatcgggcaagccctgttaccgaacaatttttaatcgttcttgcgatttcctgcacggctaaaaaatcacctcgggatgaagcgggaaatcccgcttcaataatgtccaccccgagtctttcaagctgcttggctatcgccagtttctcccgggaattgaggttgaccccgggagattgttcaccgtcacgaagggtcgtgtcgaaaacattaattttgcgcaacggagaccaccgcttccttcttcttgccttgtttgacaaacggcatcatttcacgaagctgtctgccgaccttttcaatctgatgctcgttttcgcttgcattgatcgcattgaaacgaggacggttcacttggttttccacgatccattcttttgcgaatgtaccgttttgaatatccgttaatacttgtttcatcgattcttttaccttcgcatcgactacgcgcggtcctgatacaaagtctccccattgagccgtatcggagatagagtatctcatgcccgccaatccttcttcatacatcaagtctacgatcagcttcagttcgtgcagacactcgaagtatgcgagttcaggctggtagccggcttctgtcagcgtttcaaaacccgctttgacaagcgccgttaaacctccgcacagaacagcctgctcaccgaacaaatccgtttccgtttcttctttaaatgttgtttcaagaacccccgcacgcgctccgccgattccttttgcataagcaagagccgtatctttcgcttcgcctgatacatcctggtagatggcaaacaatgccggtacgcccgcgccttgttcatatgttcttctgacaaggtgtcccggtcctttaggggcgacaaggaatacatccacatcagcaggaggcacgatctgatggaaatggacgttaaatccgtgtgcgaataccaatgacttgcccgccgtcaattcatctttgatttcagcttcatatactttttgctgctgttcatccggaagaagaaccataatgatatcagcctgggcagccgcttctcttaccgaaaagacttgatgaccgtcttcttgggcctgtgtaaatgatttaccttgtctgacgccgacaatgacatcaataccgctttcttttaagttcagcgcgtgtgcatgaccttgtgaaccgtaaccgataatcgctacttttttacctgccaatacgttctctttgatatcaccgttataatatacttttaccattttaatctctcccttttttgtgttatacaattgaaattgttttattggatgacgccttctgctgggttcccctcgcaaaagccgttgtgcccgttctcgcgatttctttaattccgtaaggtttgagaagctctatgagcgcttcgattttattagattcgccggtaacctgaacgacgatgctgtctcttgagacatcaacgacggaagctctgaacggctcaatgattccattgatttccgttctggccgacggtgcggaaacaactttgattaatgccagctcacgctgtacaatcgattggtttgtaatatccgtcactttcaggacgtcaatttgtttgttaagctgctttgtcagctgctctacgtcattttcgccttccacatggacgacaaatgtaatccttgaaacaccgcttgtttccgtgtggcctacagtgatgctttcgatattatagtgtctttttgtaaacaggccggtgatccggtttaatacccccgagcggttgaccaccgttaatgtgataatgcgtttcaaggtttcacccccaccatttcatgaagtcctttacccggcgcaatcatcgggaatactttctcgcttttggcgacccggacgtcaataacggccggttcttttgatgaaagcgcctttttaagctcttcttccgcctcttcttccgatgaaatccggacgcctttaatgccgtaggcttctgacaatttgacaaagtcaggctgcgccgagaatttggattcagaatagcgttcttcatagaagatttcctgccactgtctgaccatgcccagacattcgttgttcaagataaccactttgacaggaagattcagctgccggatgacatctaattcctgaagggtcatctgaaaaccgccgtctccgaggatggcaacgaccgtggcgttacgatcggccagctgcgcaccgatagccgccggaaggccgaagcccattgtgccgagtcccccgaggtaacccacttatcagcctttcggaaaggataaaactgagccgcccacatctggtgctggccgacatccgtcgccacaatcgcctcaccgtttgtgaattggtgaatatactcaatcagcttttggggtttcaagccctcttctctgttgtctgtataccaaagcggatattcttctttccattctgaaagctgctgtttccattcctctgtctgtccctgttttccgttttgtttcaataattcctgaaggacgattttactgtcgccgaccaccggaatctgcgtttcaataatttttccgatttcagcaggatcaatatcgatatgcgctactttggccgattttgcaaaatgcttcagatttccggtcacgcggtcatcgaaccgcgctcctatgctgatcagcaagtcacagtgataaagcgccatattcgctgtgtatgtgccgtgcatccccgccattcccagaaaaagaggatggtctgccgggaaaccgcccagaccgagaagcgtgtgcgctaccggaatttgctgctgttcggcataattttttaaatcttctgaagctttaccgtgcaaaacacccgctccggctaaaataaccggctttttcgcactgctgacagcttccacgagctttcggatctgcagatagttaggctcttttaccggctgataacccggaagattgatctcgtgatcatatctgaattctccttcaaatgctgcgacatccttcggtatatcaattaataccgggcccggtcttcccgtcgtggcgatatggaacgcctctttaatcacacgagggagatcttccggacggcggacttggtagctgtgtttcgtaatcggcatcgtaattcctaaaatgtcggcttcctggaaagcgtcgctgccgatgaccgaagtggccacctgaccggtaaacactacgagcggcagtgaatcaatcatcgcatccgcaagaccggtaactaaatttgtcgctccgggtccggaggtagcaatcacaacccccggctttccggagactctcgcatacccttctgccgcatggatcgcgccttgctcgtggcggggcaggatgtgaaccaatcctgattgatacagtttatcgtaaatcggaaggacggctcccccggatagccgaagatcatctcgacattttctttctttaatgattcaatcagcatcagagccccgttcattgtttttgtacaatcggcagacaaagaatccgcctgtacatttgtgcccattttcagttcctccttttcaatgttcccttctaaaatccaattcataaaacgcagcgccggctgacgcaaataaaaaagccttcccacccacattcagccaagcatttcatgcgatagccaaaaggggcgaaaaggctttgctctccgcggtaccacccttgtttacggtcatatgcagaccgtctcatggataatgattatccgttttgataacgagtaaacattgcgttcactcggccgagtcctactctttacatttcagaccggcactctgaggggagttcactttgatttgttttaccggctctcagcgttaccggctctctgtgaaaaacttcagcaaagctacttatcctcttctgcgctttttattatggcagctcttttattaaaaaagaaccttcatttgtttgttttttcattgttttatgatttttctttttagcgtgaatcatttatttatttttgtttgaactcatattacgcccgtttgcagacagtgtcaacagcatttttataattattagataatttagattaatcaatctactttgtatacgctttcattactggtacaaagggatctgtaaatattaaaagtttttatcatttttttattaatctctcaagattacatgaaatttttccgttcatatacgaatatgtcacattttattacgcgatttttctctgtccttccggcatgcttgtcagatattccgttcgattgaacaggctctttatacagacatacgcatacactgttcttatctcgtaagaaatgagtgatgtcatgaataagatgttatcaggcatgcagggcctgcctcctggatttccgcctttaccggtcttaccgccgcagtcttattatcctccggccccgatgcatacagcaccatatcaaggcggcccttcttttcagcagggattcccgtcatccggatacggacagcagaccccgcaaagcacgctgtcattcgccggacagcaattcgttccgtacccttatacatccgggtactacggccaaaccttcagtgacgtcggcggaagcctcggcgccggggcacatcccggcgcgctcggaggcggtttcagcggccatgccgggggcttcagcgctccgagcggattcagatgatacaaaaaccggtctcacacggccggtttcttttcttattcacagagtataacggtcattccactgattcatttcctgctccgtatagtaatcagcccttgaaacctcaacaatgattaaaccgcattgagtgattaaaaattgtttcagttcctcaaacagctcgtcttttccgcaaaagatcgtttctatattgtgatttttatatgcaaatgcgtacttcaaaagctaattcctcctgctgtctttctatcaatcatcgacaaaacatatgatagaaatcagataatttatcactcaagggcgccttaagtatctttatacatatatttattacggtaaatattacattaagtttcatttatattaaaattactttacaattttcatcaaatacggaacttttgtttcgtaaaataaaaataaaatacaaaaaaacctcaaacccattgtcagggcttgaggtttttttatacgtcccaggagagattcgaactcccgaccgacggcttagaaggccgttgctctatccggctgagctactgggacatgaaaaacaaatatctgctgatcattttaccatgatatcagcgaattgacaatatagtcatccgataaaaaaggccagcggcatcagttttcactctgatgtcaccagctctttttttgtacgtcccaggagagattcgaactcccgaccgacggcttagaaggccgttgctctatccagctgagctactgggacagcttttgctttatgtatcagcgacaagatttattatatacaggttcaaatcataagtcaatatttttttaaaaacttttgatggggaagaatgaaatctcccccatcacttgttaaaaactgattgtattccccaagtccttcaattcccgacccgtttcgtcgtaaaatgtcacggcgccttctctttctgtaagagtaagaatggcatagcttttcacattgcggactctcggaagacggatgctgcccggattaatcaaaagcttgctccgaagcacttcactcccggcaatatgtgagtggccgaagcagacgatatccgccccaagctcttccgcccggtaaaaaacagttaaaagtgactgtttaatgccgtgaagatgcccgtgaacagccagaattttctttgagccggcgtccagaaggagttcatcctgaaacccgccgccaaagtcgcaattgccttttaccgtgtgatacggcgtgagtgccggatgtgcggcgtcaagctctgaatcaccgcaatgaatcatcagatccgcttcgtcttcgtgccgctttgcaatcgtctccagctcgtcttcaaggccgtgactgtcacttattatcagcactttcattgcatacgctcccccttatgaatcaagcagctttgacagtttcttgagcgcctcagccctgtggctgattttgtttttctcagcgcttgtcagctgggccatggttttatctttatcttttacaataaaaatgggatcatagccgaacccgttatctccctcgggtccttctgcaatatacccttcaacatgaccttcgaccgtttttgtttcctgccccggcatgctgacggcaagggcgcagcggaaacgggccgtgcgctgctctttttcgatgccttttaattctgacagcaccttgtccatattcgccttatcatcttttgcttctccggcataacgggctgaataaacgcccggtctgcctccaaggttgtccactgataaaccggagtcgtctgcaatgaccattttgttgacggcttttgccacggcttccgcttttaagatggcgttttcttcaaaggtatgtccggtttcctcaatttcttccgtaaatccgatttccgccaaagaagagacactgtagcctttcggttcgagtatttccttgaattctttcacttttccctgattgtgtgtcgcaataatgacttctttcacgctgatcaggcctctctttcttatttcagttcaggcaatgtttctccgagcacttctttttgcttttgaataagcgtctggattcctttttcggcaaggcttaacagtccgtttaaatcttcacgggagaatgtggcttcttcgcccgtcccttgaagctctacaaaacgtccgcttcccgtcatgatgatattcatgtcaacttcagccgccgaatcctcttcataattcagatctaaaagaaggccttcttctttatccatcccgacagaaatggccgcgagataatctgtcacgggagaggttttgataacgccgctttttacgagtttgccggtcgcaatggccattgccaagaatgcgccggtaatggaagccgttcttgttccgccgtcagcttgaatgacgtcacagtcgatccagatcgtccgttcgccgagcttctccaaatcaacgacggcccggagcgcgcgcccgatcagccgctgaatttccatcgttctgccggagacctttccttttgaagattctcttatcgttctttgattcgtcgcgcggggaagcatgctgtattccgctgtgatccagccttttcctccgccgcgtaaaaatggcggcacccggtcttccacagatgcattacagatgacctttgtatttcccgctgtaattaaaacagagccttccgggtgagtgataaaatccaaatcaaatgtgatagggcgcagctcatcgtgctgtcttccgtcgtgtctcatattttacctccgattatatgtacataaaccttttgttccggattgtgaataaagaaagaggcagccggaacgctaacctcttttttactagtatatcaaaaatcgcaaattaaaaactacccgtattcacttgtgccggcctcgaaacaggttttgaaagggattctcctttttcattcaccagttctgattttccgtttacttttatagaaacacttttaatcgacggctgttcggttaacgtgagaacgatgctgtccagtacgcccgatgacaccatttttgttttttcgtcggcgcttccgtaaatagagctgttaaagtccagtgtaacctggccgtctttcactttcggcttgctgagaagcttaacatcgttattaaagtccgtcaaaagcccgcttgctttgcccggtccgtcggtgagctgttcaacggcagcggtgatgtcatttgtttccgaattgtcaatccgctttgtaacaggcacgtagtattcgcttgtctctgtttccgccagataatatacagtcagcggatgggtgtctgtcagatcattcactccggccgtttcaatattaatcccgtcttttctgcttaagtcgcccgtaatcggcgtgccgcccaccggcatttctttcaattcgtgcccgttgattctgattttgactttatctattgagctgaattgggtaagcgtccatgtaatcgattgcaggattttttgttcgtcttcttttttatagtttttaaattccttcgaaaaatcagcgacggcagttccgtcttttttaatatcgacatttaccgtcgtatccgcagggagcaccgctctgaagccgttcggcaggatttctgatacaggccctccctgaaccaagtactcaagggcctgctttgcggttccctcactgttcggaagaggcagtgtctgtgctgcgacatagccgtttttatcaatcagatacagctctcgcatgactgtattggccggctggtcggctttagaagtgccgtttttctctgactgctttggttttgcctgaattcccgcttcatcctttacatatgaaatgtcttgaggcgggtcaatttccccggctgttttatcggattgaaacaaaccgcatccagataacacaaaagccgaagtaagacatgttgcagcaatgactgcaggtccttttttcagcatacttttccctcctaaggctgtttgtactatgatgtatacgagccctgtccgggaaatagaccgggaagcgcaaaaaaacccgctgtaaacagcgggttttttgatttattttctgaccggctcttgaagggagatgcactcgacatggccgatttcgtgaccgaaccagtcttcggcaatttttgcgaagccgttccgctctcccgttgtaagaaattgatgctccggtgcatgtttcgattggtttaacaaacctttataagacaagatggtgctcacttctctcgccgtctcgtctccggaggaaatgattttcacatgctctcccatataattctgaatcgggtcttttaaaatcggataatgcgtacatcctaaaatcaaggtgtcaattgatgtaccttttaaaggttcaagcgatgcttcaaccgcttcctccgctgattcctgaagaaaccgtccgctttccacaaacggcacgagcagcggacaagccgtgttctcaacttgaagttctgcgtttaacccgagcagcgcctgctcatacgctctgcttttaatggtattgaccgtgccgatgacgccgatatgctggtttttcgtgacctttatcgccgttctcgcacccggctgaatgacgccgacaaccggaatatccgttttgcgctgaatatcctccaaggcaatggccgtggccgtattgcaggcgatcacgagcattttgatatggtggttttccagcaggtaatcggtcatttcccacgtgtattgaagaacttcttcttcaggacgcgggccgtacgggcagcgttttgtatctcccacatagatgatattttccttcggtagctgtctcatgatttccttagcaacggttaacccgccaaccccggaatcaatgactcctatcggctgttccaacaaaatcgcctcattttcttttcatttcatgctgcagtttcaataatgatttttcgaaagcggctgtttcttcttcggaaaatgtcgcaaacatatcccgcaaataagcctgtcttttcaaaatcacttcttggataatgcgctctccttcagcgagaagatgaattctgacgacccgtctgtcagccgggtctttgacccgctcgacaagcttatttttttccatgcggtctatcagatccgtcgtcgtgctgcaagccaaatacattttgcctgataattcgcctattgtcatatcccccaattcataaagccattgaagccccacgaattgcggcggtgtaattgcatattggttaaggatttctcttcctttttgtttaatgatcgcagcgatatggcggagtgatttttcgatatccgcaacatgctctacagattttgatgtcatttgtccatccctcactcaaggatctttctgggctttgcgctccgtgtctattttccttctttttttaagaaaatgcaagactgacggagaaaaaggaaaaaccgggattttcaccgcatgcccatcagcccgggcgccaacgcaaataaccggctccttctcgtaaagaaggaaaaccggcaagaatcagagctctagctcacccattctaagaagctcgacaacagcttgcgaacgccctttcacacctaacttctgcatggcatttgaaatgtgattccgtacagttttttcactgataaatagctcgcttgcaatttcctttgttgtcttgtcttgaacgagcaattcgaatacttctctttctcttttggtcagcagcggctttgattgaaaatctttctccttcaagtattgtaaccctccttgctaaggtgagagcgaatctgaaacgaatgggtttatatagtcaagatatcatatgtaaagggcgcttcggaggtgacgtctcttagagaaatagttatccgttcaggcgagcagaatgcctttctcccgctccgtccagctgaccgctttgccgcttttcttcgacacttgaaccataacgacggaacctgtaaagcacggcaggcccgactcattttctccaaggtaatgaagggtgacggacgcatttccggcagcgcttgctttcacataaatccgcagattttcatacggcatcacctgacgcatatagtcgcactgctggcttgcgacgaccgtcatcgtttccgagttttgcgccgtcatgccccgctgtttaaaataagcgatccgtgcttcttcaaaatagatgaaaggggttacattattcatatggccgaacatatccgtttctgaaaaacgaaccgatacttcagtaaagaaagaaaacgactgtctccattcttcaaacgggatatcaatatattgcggttgtttcatcaccttcagctccttataaaaaaacctctcccgtgcggaagaggctctttttctctttcttatactctgtcgcttccgaagaaattacggaatgcttgtaaattggtatctctgttcaaagcagcgattgaagtcgtaagcggaatgcctttcgggcaggattgaacacagttttgtgaattcccgcaatctccgaggccgccgtctgtcattaaagcttctaaacgttctgctttgttcatcgcgcccgtcggatgggcattaaacagacgcacttgtgacatcggggcaggccccatgaatttcgacttgctgttgacgttcgggcaggcttcaaggcagacgccgcatgtcatgcatttagacaattcatatgcccactggcggcgtttttccggcattctcggccccggccccaaatcgtaagttccgtcaatcggcacccatgctttcacttttttcagtgaatcaaacattctgctgcggtcaacctgaaggtcacggacaaccgggaatgttttcatcggcttcagacggatcggctgttccagcttatcaatcagcgccgtacacgactggcgcggtcttccgttgatgaccatggagcaggcgccgcatacttcttcaagacagttcatgtcccatgcgaccggagtggttttctctccttttgcattcacgggatttctgcggatttccatcagggcggaaatcacgttcagattcgggcggtaattgatttcgaattcttcatcgtatggcgcgctttcgggcgtatcctggcgtgtaatgataaaccgtatctttttctcactcatgattatttcgccaccttcttcttcgagtagtcgcgtttacggggcgcaatcagtgatacatcgacatcctgatattcaaattccggagcttcaaacggaccggcatgtttagccatcgtcgttttgagccactcatcgtcatttctttcagggaaatccggtttatagtgcgctccccggctttcatttcggttatatgcgccgagcgtgatgactctggcaagctgaagcatattggagaactggcgggtgaacatcgccccttggttgctccattttgtcgtatcgttgatattgattttcttaaagcgttccatcagctcttggattttgtcatccgttttcaaaagcttgtcgttgtggcggaccaccgtgacgttggccgtcatccattctccgagctcacggtgaagcacgtaggcattttcgtcgccgtccatcttcatgatatcggcccatttttcttcttcttttttcacataggaatcaaataatgaagaagacaggtcttccgctgatgtttcaagtccggaaacatatttcaccgcattcggtccggccaccattcctccgtagatggcggaaagcagagagttcgcccctaaacggtttcctccgtgcattgaataatcacattcacccgctgcgaacagtccgcggatgcttgtcatctgatcataatcaacccacagtccgcccattgaatagtgaacggcagggaaaattttcatcggaagcttgcgcggatcatcgcccatgaatttttcatagatttcgataatgccgccaagcttaacgtcaagctctttcggatctttgtgcgacagatcgagatacaccatgttttctccgttgatgccgagtttctgattcacgcacacgtcaaagatttcacgtgtcgcaatatcccgcggcacgaggtttccgtaagccggatatttttcctcgaggaagtaccaaggttttccgtctttgtacgtccagactcttccgccctcgccgcgcgccgattcactcatcagacgcagtttatcgtcccccgggattgctgtcgggtgaatttggataaattcgccgtttgcataataagcgccctgctgatagacgattgatgcggcagatcccgtgttgatcatactgtttgttgattttccgaatacgattccgggtcctcccgtcgccataataacggcgtcagaacggaatgactcgatttgcatattggtcagattttgggctacgataccgcggcacgtgcgctcatcgtcaagaacggcgccgaggaattcccagccttcgtattttgtgacgagacccgccacttcatatctgcgcacctgctcgtccagtgcgtaaagaagctgctgacccgtcgtcgctcccgcgtaagcggttctgtgatgctgtgtacccccgaaacggcggaagtctaagagcccttccggcgttctgttaaacataacccccatgcggtccaataagtggataatggacggcgccgcttcacacatcgcttttacaggaggctggtttgccaaaaagtcgcctccgtataccgtgtcatcaaaatgctcaaacggagagtctccttccccttttgtgttgacagctccgtttatcccgccctgcgcgcagaccgagtgagagcgtttgaccggaacgatggaaaacaatttaacggccgtgcctgattccgctgctttaattgtcgccatgaggccggctagacccccgccgactacgataatgcttgattgactcatgatagcccctctccctctagtaatctagttctcttacacaaacgcaaaaatcgcttttaaacctacgtatgaaagcgctaaaaatataatcagcgtcacgtaagtcgaaattctttgagaacgcggcgtgaccgtgatcccccatgtgaccgcaaaagaccataagccgtttgaaaagtggaaaatgaccgataaaacgcctacaatgtaaaaaccgagcataaacggcgagctcagaatattcgccatcatatcgaagttgacttcagcgcccatctgcgcggcaatccgcgtctgccacacatgccagctgacgaaaataagggtgagaataccagtgacacgctgaagcacaaacatccagtttctgaaataactgtagtggccagcgttgtttttcgcagtaaatgctatgtacacaccgtaaaccgcatgataaattaaaggtaagaaaataataaaaatttctaacgcatacctgaacggcagactgtccataaagccggccgccttgttaaacgcatccgctccccttgcggcaaattggttgacgactaaatgctggatcaaaaagatgccgaccggaataacaccgagcaaggaatgcaatcttcgaaaataaaactctctgttcccagacattactttaccccctgtttgatttaagtgcgaaatgtactaaaatctctgcccccacttcgtttcaattgtaagcactttattaaaatttattgacaatttcattttactcctccctcaaaagggcgtcaagaaaacgtgtacataaattataattttcggaattgattatctggagggaaaattttattttcctgcgatatctttctcactttttttcacgggttttataggatcatcctgtaatcctccccctgtttaagctataataaacgaaggagagaggggaatacataatatgaagaataattatgaagcagctttagaacctttaactgaactcgacgtcagcgcatacggctacgaattaatccgggaaatcatgcttccggatatcctcggcccggagcattcatcgatgatgtattgggcgggaaaacgcctcgcccgcaaatttcctcttcaatcgtgggaagaaatccccgccttttttgaaaaagccggctggggaactttgacaaacgcaggatcaaaaaaacaagaattggaatttgaactggaaggaccgctcgtgtccaacaggctcaaacatcagaaagagccttgtttccagcttgaagccggttttatagccgaacagattcaattgatgaacgatcagattgcagaatcttatgaacaggtaaaaaagagagcggataaagtcgtcctgaccgtaaaatgggatatgaaggaccctgtataattgaaaaaaggcggtgactccaagtcccgcctttttgcctgcccgtttatacggcagacggctgtttagaaagctcaaacgcgtcatgaagcgcttcgaccgctttcaccatatcattttcgttgacaaccgctgatacttttatttcggatgtgcttaccattttgacttgtacatttttttccgccagtacggcaaacatgtccgcggcgacgccgggatttgaaaccatgcccgacccgacaatggagactttcgccagttttctttcggtttcaattttttcatagtcaagcgcgtttttatattcttcaagcacggcgaccgtttgcgcggcatcttccgttttcactgagaaagaaatatccgcttccccatcgtccgactgtgtctgaataataatgtcaacgttgatgtttcgttttgccagcgcggtgaagattgttgaaagtgttgtcagtccgcttgcaaggcccgtaacggacaccctcgtgatctggtcttcaaatgcaattcctctgacgattaaattctgctccattgatgattcctcctcaattaatgttccggcttcatgctccgtgcttgaccgcacttctaaaggcacttggtagtttttcgcgaactcaaccgcccgcgggtgaagaacacccgctcctagatttgcaagctccagcatttcatcataagaaattcccgccagttttctcgctgaccggacataccgcggatctgtcgtaaatacgcccggaacatctgtataaatgtcgcatttatccgcttccagcgctgctgcaagagcgaccgccgtggtatcggaaccgccccgtccgagcgtcgtgatgccgccgtcttccgttacgccctgaaaaccggcaacgactgtaattttaccttctgcaagctgcgaacgaatcgccgtgatatcaatatccgtaattctcgcattgccgtgaacggcttccgtgcggacacccgcctgccagcccgtataagagacggcgtcatatcctttttcctgaagcgccatggccaaaagcgaaatcgtgacctgctcccccgtagacaaaagcatatccatctcgcgtctgcttggttcagatgtgatttcagccgcgaggttaacgagcgcgtcggttgattttcccattgccgaaacgacgactacgacatcatggcctttttgcttttcagcaatggcgcgatttgcggcattttgaattttttcggcagagccgacggaagtgcctccgaatttttgtacgataagacccatactagaccaccctttacattttggttcgtgcgggtgaggagaaaagagcgttttgtccacaataaaaaaagcaatgagaggaatagctctcattgctttttcatatcagtacgattgattatgaacaacgagatagccctccaagaaaatgaattcttgacagccttacatttatttaatgcaaggccagcaaatcacaccgatgggatgtgatacacttcggcgacgctcccctttcagcctttttcgcagaatccatcattctccaaaggcttactattgaagttcgcacctctatcttcaccatataacacgatcttatgaaattagttcacattctagcagatttttcaggaaagcacaatactatttttttaatttttcaaacagcagctgggccgccgcggccgggacaccggcttttttgatatcgtcaaggcttgcttccttcatctttttgacagatccgaaatgttttaagagcatttttttgcgtttttcgccgattccggggatatcatccagaacggattgaaagacgctttttccccggatctgtctgtgaaagctgatcgcaaaacggtgaacttcgtcctgaatgcgctgaagcaggtaaaactcttggctgttccgctccagaaacaccggttcaagcgggtcgccgatcaaaaggttcgatgtccggtgcttatcatctttcgccaatcccgctaccgggacatcaaggccgagctcattctcgagcacgtcgcgcgccgcgttaatctgcccttttccgccgtcaatgatgattaaatccggcagcggaagattttcgcggagcaccctcgtgtatcttcttctgacgacttccctcattgagccgtaatcgtccggccctgttacggttttaattttatatttgcggtattcctttttattcggttttccgtctataaagacaatcatggccgatacggggtttgtgccttgaatattggagttgtcaaacgcttcaatccgatgcggcgtgtaaatattcagtgcgtcgccaagccgttcggctgcaccgattgaccgttcctcatcccgctcgattaacgagaatttttcccgcagggcgattttcgcatttttgtgcgcaagcaaaagcagctcttttttcgggccttttttcggctgatgcacggcggtttccaacagctcgctgatcatgtccctgtcaacgctgtcaggcaccagaatttccttaggcagaaagtgattgtttttggaatagaactggccgatgaaggtcagaaactcttcatccgcttcctgatacatcggaaacatgctgacatcgcgttcgatcagttttccttggcgtataaaaaagacttggacgcacatccagcctttatcgtaggcatatgcaaacacatcgcggtccagaaggtcattcatggtcattttctgcttctccatcgtcgattcaatgtgagcaagctggtcgcggaattctttagcccgttcaaattcaagcttttcggccgcttctgccattttcgcttcaagctcttttttgatttcgttatgccctccctttaaaaaacgggtgatgtcttcaacaatctcgcggtttgtctcctcagatatatcctttacacatggggcgaggcattgtccgagatgataataaagacagacgcggtccggaagctttgagcatttcctgagcgggtaaaggcggtccagcagttttttcgtttcccgcgccgcctgcacattcggatacgggccgaaatagcgtcctttgtcttttttgacattccgggtgacaatcagccgaggatggcgttcatgggtgatttttataaagggataggttttatcatctttcagcatgacgttgtatttcggatcgtattttttaatcagattcatttccaaaataagcgcttcaagattggaggaagtcacgatatattcaaagtcctcaatctccgtcacaagccgttgggtttttgcgtcgtgagaaccggtgaaataagaccgcaccctgtttttcaagactttcgctttccccacgtagatgactgttttttgacggtctttcattaaataacagcccggctgatcgggaaggagggccagcttttctttcagttgtttattcatacgttacccttccttacattcatttctcgtgtccattcagtgtatcacgaacatttgtttttctccattctcagcttttggaagatcaaaaaaaggcgattccctttcaaaggaatcgccctgccgtaacggaagctttcggcttacagatgtttgtttacaagctcttcaagagcttctttcggtttgaagccgacagatgtttcaacgacttctccgtcttttagcacgagaagtgtcgggatgctcatgacgccgtatttaccggcagtttcttggttttcatccacgtcgattttgacgattttcaatttgtctcccatttcttgatcaagctcttcaagaacgggcgcgatcattttacaaggtccgcaccaaggagcccagaaatcagccaatacgacaccttcacttgtttcagctgagaacgattgatcagttgcttttacgatagccatttgttattcctccaattgtcaaatgatgatttttagtatagcatctcccattcgttcatgctaatttaatgcttatattattttctcccgaacccgccggaaataatcttatttatacagtgtattataaccgggcggcgggcgttcaaaacttaagatggacccgcaggcagcgtgattaatacaatcgccatcggaggaagctccgcctcaagttttcctcccttttgagcaaacccggaaaacggcttcggtttgacgttttccggactgctgaatgtattgcgggcattcattttttccgcgtgcagaatcgttcccgaaggcgtccctgtctttttcatgccccgcagttcaatcttcacgtcagctttgtgcagatgatcgatattgcaaatgctgatatgtatgtctccgttttgctgtttggacgctgaaatgctgacttgcgggagccggccgtcattccattcgtacccggccgctattgtttctgaggctaaaagagatgcgtcctggtgcaccttaaacatatcaaacacatgatacgtcggcgtcaacagcatatcgttcccttctgtcaggatcattgcctgaagcacgttgacggtttgcgcgatattggccatctgtacgcggtctgcgtgctgatgaaaaatgtgaaaatgcgcggcggcgacaagggcgtcgcggatcgtattctgctgatacagaaagcccggattcgtgcccggctcaggatcaagccacgtgccccattcatcaatgatcagcccgactcttttttcgggatcgtactgatccatgatggcgctgtgccttgtgatcaattcatccatatgcgccgcttttttcatcgtgatgaaccattcatcttccgtaaactccgtcgctgatcctttccccttccagaagtcgcccggtattgtgtaataatgcaggctcagcccgtccatgagatcagcggcttttttcattaaaatttcagtccagcggtaatcgtcgacattcgcgccgccggcaattttatagatttcattaccgctgtaattgcggacataggtttgaaagtttctgtaaaggtcggcataatactcaggatgcatgtttccgccgcagccccagttctcatttcctattccgaaatatttcagcttccacggtgtttcccgcccgttttcttttctccagtcggacatcggcgtgcctgcttcaaacgtcatgtattcaatccaatcagccatttctttaaccgttccgctgccgacgtttccggcgatgtacggttcacatccgagcagttcacaaagcatcataaactcgtgcgtgccgaattcattagaatcaatcgtcccgccccaatgggtattcagcatggttttgcgtttccctacaccgtttgcccaatgatattcatcagcaaaacagccgcccggccacctgaggacgggaatctgaagctgtttgagggcggcggcgacatccgtcctgacccctccggtattcggaatatcggaatcttttccgacccagatgccctcatatatgcctcttcccaggtgttccgcgaaatgtccgtatatgtttttattaatggttccccgtgtgatatcagtttgaatgactgccgtattgtgagacaaacttgatcattccttccccttaataagaatgaaagcactagagccgatctatctgggatgtatgctgaatggataagtttgtaagcgctttacaaaagcttattacattggttcgtacatgtcaatctattgttttattaatctgtaatttgtacgaactaattaacacaaatcaaaaccctctgacaaataagccagagggttttgattatgaatgaatattggcatttttaaattcctgggtcagaagcggtaccacttcgaacaaatcgccgacaattccgtagtccgctattttaaatatttccgcttccgggtctttgttaatggcaacgatgaccttactgtttgacatgcccgccaaatgctgaatcgctccggaaatgccgcaggcgatatacaaatccggcgtgacgacttttcccgtctggccgatttgaagagaatagtcgcagtagtccgcgtcacacgcgccgcgcgaagcgcccaccgctgctccgagcacctcggcaagttcttttaacggttcaaatccatctttgctttttacaccgcggccgcctgctacgataattttcgcttctgataaatccacgccgtccgccgtttttttgactacttcttcaatgaccgtccgcaaatctgccggaggcgccgcaagctcttcaatatcacccgtccggttcgcgtctttttctaatgcctgaatattattcggacgaattgtcgccagaatgaaaggatcggttgaaatcacctgttcaaaggcttttccggaatagatcggtcttgtaaaaacgatgttgtctccggtaacgcttacatccgtgctgtctgaaatcagccccgtttcaaaccgggccgcaagcttaggtgacaaatcttttcccatagaagtgtggccgaaaatgaccgcatcaggcttttcattttcgatcaaatccccgagaaccgcggcatatccgtccgccgtatactgagaaagccccggcgaatcggctgtaaatactttgtcggcgccgtactgaatgagttctgatgctgcatcagccgcgccttttcccatcagcacgccgatgacatctcctccgccggaaatggttttgcctgcggctatggcttcaaaggtgacgttccgtaaggcgccgtcacgaatttctccgagtacgatcactttttttcccattctgacatcccccagtttctttaatatcggtttatacgactttggcttcttttctcagcagtgacacaagctctttcgcctgctcagcggcttctccttcgatcagtctgcccgcttctttttgcggcggcagaaaacgttcgatcgttttgagcttcggtgcggcatcatcttcatcaatgccgagatcatcgagctcaagttcttccagcggttttttcttcgccttcataatgcccggaagcgacggatagcgcggctcgtttaagccttgctgtgccgtgatgactaaaggaagtgaggttttaatgatttcggtatccccttcgttgtctttctctgccacagcttcatcgccgctgattgtcagttttgtaatcgttgtgacgcaaggaatgttcagcagttcggcaagccttggagccacttggccggaaccgccgtcaatcgcgacatttccgccgagaatcagatcatattcccggtccttgaaataatgatataagatagttgaaatggagtattgatcaggatcgctcagatcatcttcaatattgattaacaccgcctggtcacagcccatcgcaagggcggttctcagttctttctccgcatcttctccgccgacggttacggcggtcacggttccgccgtgctcttccttcagctgaatggcttcttcaatggcgtattcatcatacggattaatgataaattcggccccgtcctcctgaatctttcctgcttcaatgacgattttctcttctgtgtcaaacgtccgtttcatcagtacaaatagattcatattcttatcccctttatcttcgcccaccgaattgaggctttcttttttcgagaaatgcctgaatgccttcttttgcgtcatctgatgcaaatgcttccccaaagcgctttgcttcaagctttaagccgccgtcataagaatagaccttgtttgaataaaggagctcaagcagagaagccatcgactgcgggcttttttccgcaaacttgcccgcgagcattttcgctttttgcagcagctcttcctcatgttcggcgcctatcgtgacaagaccgaggctgagcgcttcttctccggtcacaggttctgaagtgccgatcatttcaagcgctttcgccgtaccgacgtaccggggaagccgctgcgtcccggcaaagcccggaataatgccgagattcagctcgggcaggccgagctttgcatccaatgttgcgattctgatatggcaggccatggcaagctcaaggccgccgccgagcgcagcgccgtgaatcgccgcgataacgggcttcggaaacccttcaattctttccatcagctgctggcctttatccgccatggcagaagattgctcaagatttttaagcgacgtaaattcctttatatcggcgcccgccgagaaaaatttcccctctccgcgaataatgatgcttctgacactgtcatctgtttcacagcggtcgaacagaccggacaactcatctaaaaccgcaccggacagcgcgttggccggctgatgattaatggtgatcaccgcaacagattgttctaccgccatcgaaaggctgttcatccgtcaaccccctttagttttgatgaatccctgacaccaacagctccaataccttgtctgacaaatccggaagatcatatttctgatcgttcatcacccatgttgtcactgtttcatctatcgtcccgaatatcatctgccgggcgaggcggacgtcgagattatctttccattcgcccgactcgattccttcggtcaaaatggtgtccagcatgtttaaataaccttttaaaatatcattgattttcaggcgcagcttgatattcgactgtctgagctcaagctgggtcacaatcgcgaggtggcggtcattgccgagcagtgtgaaatgctgcttaataacgagagcgagtttttcttttgccgtcgttttttctttcacttcttcttccatgcgttcaatgaactggcccatcttttctttaaaaagagaaatgagtatatcctctttgtttttgaaatataaatagatggtgccgtccgcaacgccggcctgcttggcgattttggacacctgtgattggtgatagccgttttccgctatgacttctactgctgcatcaataatctgcatatactttggccgtttttggttcaatgtcatcgttccttccttcaataaatgaatgactattcattcataacttcataataaaaaggaatccggattttgtcaagtttttcttttaaggcaccttgttttcatgggaagcatcttcctcttcgactaaacgccttcttaatatttttccgacggccgttttcggaagctcttttctgaattcgtacagcttcgggactttgtacggcgcaagccgctctcttgcaaacgcatcaagctcatcgggatctgcctcagcgccttttttcaaaacgataaatgctttcaccgtttcccccctgtaggaatcaggaatgcccgctacgacgatttcctgaacagcttcatgctcataaagcgcctcttccacctcccgggggtagatgttgtatccgccggcaatgatgatgtcttttttcctgtcggcgatgtagaaaaatccttcctcatccatatatcccatatctccggtaaacagccagccgtctctgatgacacgcgccgtctcctcctgcttattccagtatcctttcatgacctgagggccttttacgatcagctcgccgtgttcatacggctccgcaagcccgcttttttcttctgaatatattccggcgtcggtattgggccagggacagccgatgctgccgggtttattttttccccagatgaagtttgaatgggtaaccggtgatgcctcggataatccgtagccttccacaagctttcctccggtcactttttcaaatttctgtttgacctcaacgggcagcgccgctgaaccgctcggacagcttacaatggaggacaaatcatacttatccagctccgggtgatgcagcagcccgatgtaaatcgtcggcgccccggggaaaaccgtcggcttcagcctgtcgattgttttcagggtatcaagaggattgaatttgggaagaaggatcatttcacatccctgcataatggaaaaattgagcacggcggtcaatccgtacacatgaaaaaaaggcacgatgccgagcaccttttcggctccctttttcattttatacatccaggcggcgcacatttctgtattggcctgaatgtttcggtgtgtgagcatgacgcctttcggatagccggttgttccgcccgtgtattgaagcacggcgatgtcatgcgcagagtcaatatcaaatggctctgcttcctccgctttttcgtcttttaaaatatccgctaatttgtgaatttgttcgcagccatcgtaatcaatatgcacctgttgtttttgcgtgagcgtataaagcatttttttcggaaacggcaaaaagtcttttatacttgttgtaataatgcgtccgaccagtgataacgttttcatttttatcactttcggaaacagcatatcgagggtgatgatcacgcgcggcgcactgtctttcagctgatactcaagctcgtgttccgtgtagagaggattggtctgaacgacaatgccgccggcaaacaatacgccgtaaaaagcgatgaccgactgcggacaattgggcagcataatggcggctctgtcaccttttttcagacctgttttgcgtaaaaaagcggctagctttaatgaatctgtgagaacgtcttggaatgtgagtttttttccgagaaaataaatggcggtgtggttcgggaattgagctgcggagtttgtcagattggatggcagggtttgatcagtaaattcaagctcatgcggaatctcttcgggatattgagaaagccatggcttttcagactgcataatacctctcccttctgttttcctatacactattattatagcagaagggtgattggaattggaaagcgtttcatgtgaaatttcgagtctcaggaggtgttgagtttgctggaaacgctgcattttgaagagggagttcctatcctgcgccagctgccgaagccgtttacgtcggccgcctttttgcttcatccctttgtccggatgccggatgggtgggaagagcaaaagcgcaaacggccttatgaacatatgtatccgagtgatgaggagatcatcgcgatgggcagacccgtttcctggcaaaccgtcatgagcatttgcggcctgcgttctgaaaaagaaacggcgcttgcgcttatgactgctgtcacggcattgcgggaggaatatgcacatcctgaatccgccgagcggttaaatcggctccatcccgatctgtacttgccgagcgatgatgtcacttcgccatttttgattccgggacttttggatgtgttccgttcaaaaggcataaagcgctgcacttattatgagccgttcgaagagaaaggcatatttttactcaatcaaacggcggcttcggatgtatgcggactgctgcgggctgacatgatcattgccgatgtaaagcggcgcgccgcttttatgagcatatatgattcttttacgacactctttcttatggaagaacaagacatgccgtctgttgtccacgccatgaattgggaagccgtcatttgctctgatacggcctgcataaactggtattctcaataaaaaaaggccgccgatttgagttcggcagccttttttcagtattaagatgtcatgaccagataaataagtccgatgaacagaaaaatccccgctgccgacagcagcactttcgcaagcttctccatttttccccgtccccttaaatcccggcggccaccacaaatgacaggccgactgagatgacaaatgaaataaagccgacagctctgttatctttttcaatttctttatcaattttaaaccggggcgtcagaaattcaaagataaaatagctgattaaaagcataataaatccgtatacgccccagccgatcatttgcaaaagcgaattatgctgggcgatgctgtgctgaaagacatttgcgataccgagaattttccctccggtcgccattgccaccgcaagattgcctttttggatttccacccagtttttataggatgtcaccaattcaaacacggtcagaaaaatgacgagacacaagacggccacactgtaataagccgcgatttcaacaagctcattttcccaaaaagcattcatgacgttttctccctttttattttagttcgacaatcgttacgcctgatcctccttctcccgcttccccgaaccgcgagcttttcacgctgcggtggtttttcagaagatcctgcaccccttttcggagggcgcccgtgccttttccgtgaatgatggacactctcggatagccggcaagcaccgcgtcatctaaatatttttcgacgcggctgagggcgttttcgtaacgctctcccctgaggtcaagttcaagggatacgtgataatccttcccttttacggcggtgattgctttttcttttttcggttcaggagccgatttgagaaactcgagatctttttccttcaccttcattttgaggatgccgatttggacgttccattctttctcgccggttttttcaagcagcgcccctttttgtccgaatgtgagcacctttacttcgtcgcccggcttcagctcgcgttttttctctgtttttctttctggctgctttgatttttcaaaagccggcatcgcgtctccgagacgttttttggcgtcaatcagctcgtgttccttaaaggatctgtgttcttgcttgatggacctgagctcgcggataatctgttcggcttcatttgcggcggcttccagtttttcagcagctttccgctcggcttcttccatcattttatctttttgggcgttcagctcaatgatttgctgctgaagctctttgtgcagtttttctgcttcttttctgagtgattcggtttcagaaagctcttcatccgctctttttttgcttttttcaagcgatgcgatcatcagatcgacttcgttatgttcggcggtcatttctgacttcgcctggccgatgatatgctccggaagcccaaggcgtcttgagatttcaaatgcgttgcttcggcccggcactccgatcagaagcttgtaggtaggcgaaagcgtttcaatgtcaaattcaacgctggcattcatgacgccttgtctgttatatccgtatgctttcagttccggataatgggttgtcgcaagcactctggcgtttgtccggtgaacttcgtcaaggatgctcatggcaagcgccgccccttcctgcggatctgttccggcaccgagttcatcgaacagcacaagactgttttcagacacgtcttttaatatattgacgatattgaccatgtgggatgagaacgtactcagactttgttcgatcgactgttcatcgccgatatcggcaaacacattgtcaaatacggctgcttccgatccctcatcagccggtatgtgcaatcctgcctgcgccattatcgtcagcaacccgagtgtttttaacgtaacggttttaccgcccgtattcggtcccgtgatgacgatcgttgaataatctccgcccagttcaatatcgttggccacgacttgatcttggggcagcagcggatggcgcgcttttttcagacggataaagccgtctccgttcatgaatggttttatcgccttcattgcttttgcgtatctcgctttggcgaaaatgaaatccagtgtctgcagcacttccacattttgagcgatttcttgtgtgtgttcagcggtatgctccgtcagcatccggagaatccgttcgatttcctgtttttcttttactttcgcctgctgaagcgagttgttcatatctacgatcgcctgcggttcaataaacagtgtcgcaccggatgaagatgtatcgtggacaattccgccgtagcttgatctgtactcctgtttgaccgggatgacaaagcggtcattccgaatcgtaacgatggtgtcagacagcattttagaagcggaagatgaacgcagcatcgattcaagccggtctctgactcttgattcaagcgtcctgagctgtgtgcggattccccttaaagcgggagacgcatgatcaagcacttcaccatggtcatcaatgcaggagttaatctccctttccaaatcgcctaatgtaatcagctcttctgcatgggcctgtatcagcggaatgccgacgccgtcttctgtcatttggctgataaaatgcttcatttgtttaacggcatacagcagcccggacaattcggtgaattccgccggcgtcagcacactgccgatttccgcccgccgtaaagcggatcttatgtcggtcaggccgccgaacggagcatggcctctcaagcgcatgattgcggatgcttcttcgacttcatccagctgtttttggatgtcggttagatccgtcaaaggtttcagctgcagaagtttctcccggccgagcgatgaggcggcatgtgcggtaatctgttcttttactttatgaaattcaagtgatgataacactttttgctgcacggtattatggtcctccttacttaatcattgcgcgtcagaaatgctttgacctcatgtagcggccgggcgtttaacacatgttttgtctccgtccagcctttgcgcgcagcggtcacgcccgttttcatatcatcgagcatctcgatattatgggcatcggtattaatgaccaaagtcacacctttttcatttgctttgatcagatgctcagtccgtaaatcgaggcgcgcggggtttgcattcagttcaagcgccgtatttgttttggcggcgagctcaatcagcatatcgatgtcgacttcatagccggcccgtctgccgatcaggcggcccgtcgggtgggcgataatgtccacgtgcttattcgtcagcgcctgttcaagccgtttcataatgacatgctccggctggctgaaacttgaatgaatagatgcgatgacaagatccatttcagacagaacactgtcatcataatcaagcgaaccgtcggggagaatgtccatttctacgcctttaaaaatatgaaaatgttcaaattcagcgtttaacgcgtcaatttcttccgcctgttttttgagccgttcggccgttaacccgttggctacctttaaatattgggaatgatcggtgatcgccatgtactggtagccttttgccatacatgcttctgccatttctctgatggaaaaagcgccgtcactccaggctgagtgcatgtggagatcgccttttatcgctttatgctccacaaggtccgtttcttcccggtacgtgtcgacctcctgcccgctttctctgagctcaggaggaataaacggcagaccgaagtgggcgtaaaacgcttcttcgctcgggaatgttttgacgtctcccgtttctatggtttctactccgtattcactgatccgttcaccgcgctctttcgccagctggcgcattttaatgttgtgatctttagaaccggtaaaatgatgcagtgtggtggcaaactgttcctctgtcacaagccggaaatccacactcgtctcatattcaaatgtgaggataaccgatacttttgtatccccgctcgctatcacgtcttttacgttcgggagggaaagaagctgttctctgacagcctccggatgatctgtagcgataatgtaatccagatcttttacggtttcccgcgctcttctgagactgccggcccgggaatatttctgaatatccgtcagccgggccaaatgttcttcaatgactgaagcaatgctgagcgcatagccgatcggaaaccgttccggctgttttccggcttctccgagagcctgaaggattttctcctccgtttttttgccgaaaccggcgagcccctgtactttttgctgctcgcatgcttctttcagcgattccgcgtcatgaacacccagttcctggtacagcttggcgatttttttgccgccgaggcccggaagcttcaaaagaggaaccaagccttccgggacttctttctgcaattggagaagcgtgccggacacaccttcctgcatatattcacgaatgacgccgtaggtgccttttccgattccggataaagacatcatgtcgtcgatttccgacaggctgcggtcatcctgctcaagcgccgctgccgcttttcggaaggctgatattttaaacgggttgtcccctttcagttccatatagaccgcaatcgtttcaagcagcctgatgatatcttttttatgcatactgttaacccccagtcgtttcctgcttttcatcatacaaatttttctcctccggcacaactgacgcagagcttgaaaaaaacttctccggtcaagagaagttttttatgccccgtactgggcccacagttcttgcaggagccctgacagatacggcgtatgatgtgtgatgatatttgcaagcgtcgattgtgcgagcatatcctgaagcgcgcttaccggcagtacggatgcgacgtataacaggataaacgcaaataaatagacttccagaaatccaagcaccccgcccagcagtttgttgatctgtttaatgaccggaatgccggcgatgatattaagcgccgctccgataatccggagcagaatctttgcgatgataaacaaaatgacaaacgcgatcgcgttgtaataagccgtctccacgtttcctttaataaaagacagagccgcctgcccgccggaaaaatcaggcgcgggtataaaactcagatgcggggccagatttttgtaaaaaagcgccgcaaacgcaatcgagaggatgaagctcgttaaatatataaattggaggataaaccctctttttaatccaagcaatgtgcccattaagagcagaactaagatgatgatatctatcatatggtgttcattccttttctttaagctgccgctccagtatttcatatttttcttgcagtttcatataatcatgcacgacattgaccgcagtcaatacagcgagcttatttatatcaagatatggatttttctcgttgatttctctcattttatcatcaaccattccggccacatggcgcatgtgcgctttgctttcttctccgataatggtgaagtgctggccgtaaatgtttactgtcgttttggtttttttgccgtcagacaacgtttctcctccattccgcgagaatcctagttcctatcataccacgattatcgtttgaatggaaagacgagcctcgggctgttatgatacactggtatatacagtgaaaagtgccaaaaaaggagattatatcgtgtcccattctgttataaaagtatccgcttccgctatggaacaaatgaaacaatcctatgccggctccctaactcccgccgttccgcagggcgccgtcttccaggccaagcctccgggctgtaccattacagcctaccgctcgggcaaggttctctttcaaggaaaaaacgccggcacagaagcggcccgctggggaacggctgaggcaccgaaagcaaagaaaaccgtcaaaaaagcggttgatccgctttacgctcccccggcgggcattgcctccatgtcagtgatcggctctgatgaggtcggaacaggcgattacttcgggccgataacggttgcctgcgcttacgcagacaaaaccaagctttctttaatgaaagaactcggtgtgaaggattcgaaggatttaaaagatccgcagattattgaaatcgccaaactgttaattaaaaccattccttacagcctgcttgtgttaaaaaacgaaaaatataatcagatgcaggaaaaaggcatgagccaaggaaaaatgaaggcgctccttcataatcaggcgatttccaatctgctgagaaaaatgaacggcgttaaaccggaagcgattctgattgaccaattcgcagagcccggcatttattttaagcatctttccggacgggatatcgtaaaagaaaaaacgtttttcagcacgaaagcggaaagcatacatctttccgtcgccgcagcctctatcattgcgcgatattctttcttaattgaaatggataagctttcccgtgaggctgggatgacgattccaaagggcgcggggccgcacgtcgatgaagctgccgccaagctgatcatcaataagggagaaggtgcgctcagaacgttcaccaaacttcattttgccaatacgcaaaaagcgaaacgccttgtagaacggaaacggtcataataaaaaaagcttgcagaatgatctgcaagctttttctttatcctcttaataccgcctgatacgtttcttccagcgctttcagcacgttttcatgtacttttgtcacttcttcttctgtcaatgtttgttcagggttaacatattggagcgagaaggcgacggattttttgccctcttccatatgctcaccttcgtacacatcaaatacggtgacttctttcagcagcgcgccgccggcttctttgatcacggcttcgagctgtccgcttgtaacggttttatctgccacaagcgcaatgtcgcgcgtgacggacgggtacttcggaatcggcgtatacacgacaggttctgtttcctcggtcagaagcgcgtgcagatcaagctcgaacacatacgtttctttgatatccagctctttttccattgccggatgcacctggccgataaatccggcaagcgaaccgttcaatagaatgtttgccgtccggccgggatgcatgtttttgcgttcagactggacaaattcaacccgatctgacacattcaattgatgcagcaggccttcaacgattcctttggcgacgaagaaatcaaccggctttttctcaccctgccataaatttttgcgccacaatccggttacagctccggcaactctttctttttcaaccggttttgtgttttcttctttcgtcagaaatacagaacccgtttcatataaagcaacggaatcagtctgtctggccagattgtatgaaacggcttcaagaagattcggcacgaggctgtgtctgagaatgcttctttcttcgctcattggcagagcaagcatcgtgttgaatgatttttcaatcgcaaaagcggccgcttttttatcattcgttaatgaataagtggtcgcttgtgaaagacccgctccttcaagaaaacgtctcactttccggcgttttgcctgatacggtgtcaagccgcctgtcgtgccggccgtttccggaagcgtggacggaatattgtcatatccgtacaatctcgccgcttcttcaatcaggtcttcttctattctaatatctccgcggcgcgacggcaccgttacgacaagaacgtcttcagcttcaccgactgcaaacccgaggcgcttgtaaatgctgatgatttcttctttagcgattgccatgccgagcacggcgttcactttttcaacagacacgtgaatgttgtttgcttcgattttcagatggttttcttcaaccgtgcctgagagcacttctccgccggcatacgcctgaatgagactgcaggcccgttcagccgccagcaaaacgcgggccggatcaatgcctttttcatatctggcgctcgcttcgcttctcagtccgaggtctctcgatgctttgcggacggtctgtccgtcgaaataagcggcttccagtaaaatcgcagtggtgtcttcacggacttcagactcagctccgcccatgactcccgcaacggcttgcgctttttttccgtttgtgatgaccaaatggctgcttgacagcttgcgctcttgttcatccagcgtcacgatggtttcgttttccgccgcttttctgacgacgacctcttttgaaccgaatcggtcgtaatcgaaagcgtgaagcggctgtccgtactcaaggaggacgaagtttgtaatgtccacgacgttattatgcgggcggatgcctgcattcatcagcttcgtctgcatccaaagcggtgacgggccgattttgacgtttttaatgatttttgcggcataatgcggattggcctgcgtatcttcaatcttgacggagacagcatccgccgctttttctgccgctttttcatatgaagcctccggaagctttacctctgcgccgaggatagccgcaacttcataagccacgccaagcatgttcatcgcgtcggcgcggttcggcgttaagcccaattctaaaatcgcatcatcaagctgaagggccgccattgcgtcagctcccgtttcagcatcattcggaaaaacgaaaatgccttccgcatattctttcgccacgagcttgctttcaatgccgagctcctgaagggaacagatcatgccgtgagacgcttcgccgcgcagcttggcttttttaattttgaaattgccgggaagcacggctccgaccgttgcaacggcaaccttctgtcctttatcaacattcggggcgccgcagataatctgaacgggttcctccgcaccgatatcaacaaggcatttgttgagtttgtcggcattcgggtgctgttcacgctcaagcacgtgtccgatgacaacgccttttacgccttcccctttatactcaataccctcaacttcaataccggctcttgtaattttttctgcaagcacggccgggtcgattccctgcaagtcaacgtaatcttctaaccatttatatgaaacaaacatgtgtatcctcctcttacgcctgtttaaactgcgaaatgaatctgacatcattggtatagaaatggcggatatcttcaatgccgtatttcagcatcgcgatacgttcaacacccattccgaaagcgaaaccctggtattcctcaggattgaatccggccatcttcagcacgttcgggtgaaccatgccggcgccgagaatttcgatccagcctgtttttttgcagacggagcagccttggccgccgcacttaaagcaggttacatccacctcgacagaaggctctgtgaatgggaagaagctcggacggagcctgatttcacggtcttggccgaacatttttttggcaaccaattcaagcgtgcctttcaggtcgctcatgctgattttgcggtccacgacgagaccctcgatctgcatgaactgatgggaatgtgtcgcgtcatcgttgtcgcggcgatacactttaccgggacaaatgattttgacggggccttttcctttatgcttttccatcgttcgcgtctgcaccggtgacgtctgcgttctcatcagcatttcttctgtaatgtaaaagctgtcctgcatgtcgcgggccggatgttccttcggcaggttcagcgcctcaaagttgtaataatccgtttccacttcagggccttcttcgacggtatatcccatgccgataaataaatcttcaatttcttcaataacgaccgtcagcggatggcgtccgccaatgtttacctgactgcccggcaacgtgacgtcaatcgtctggctgctgagttttttattcatctcttcttgttcaagctgttcatttttcgccgtaatggctgctgcaatgcgctctctcacttcattggcgagcgctcccattttcgggcgctcttcggcggacagtttgcccatgccgcggagaacttctgtaatcggccctttttttccgagatattgcacccgaatgtcgttaacttcttttaatgaacccgccgcttctactttttctgcagcttccagttcaagttgtttaagcttctcttccatcatgcatcctccttttatgtaaaccaaaccgttctatgcctttttcagaaaacaaaaaaacccgccccttgagagaagggacgagttgtggccgcggtaccaccctttttaaggcagacttcatctgccgacagcttcattgacataacggaaacgatcgttccggttcacctttacgcgcgtttggcgcggtcccggtgacaactcgagaggtgaaaatcaatttctgtgctgcgataaaaatgctctcagtcagcggcattttctccctggaaggcagcgtgtgcaaaaattgacgtcctctgtcacggtttttacattattgctatctattatagtgaaatccaaggcttttcgcaacctatcctctgagatgataaacgaggatggcggccgctaccgccacattcagcgattccgcctgtccgtacagcggaacgtacaggttgagatcggttttttgcagaaggccggcgtccactcccgccccctcgttcccgacgattaacgcgaacgattcttcaggcttcacgctttgataagcggcaccgttttcaagcgccgtgccgtagatcgcgacgccttgtgatttcagctcagcggtaaactcatcaagcggacgtttcaaaatgggaatatgaaaatgagatccctgtgctgaacgcagcgtttttccgttgtacgggtctgccgttccctcaccaaggacaacggcgtcgattcccgccgcatctgccgttctgatcattgttcctaaattccccgggtcctgtacggcatcaatcagaagcagccgcttcagctgatcaggccgcttatccggcatatggcagaccgcggcgatccgctgcggcgtttccgtttccgtcacggctgaaaacgcgtcttcgctcagcacgtagcacggaatgctcatgtccagatcggccgggatggcgctctcatcgtttacgagaatttcttttaccgttccctttgatttgagcgcttcttctgccagatgctctccttctatcagaaatgtattcgttttaagtctctctttttttgtgtgaagttttttccagtccttcactttttggttttttgcagagtcgattcgtttcactttatgtctgtgctctccttttttcatgcatgttgttattatatctcaagaacagcacataataaaccgcgtgcgcggtaagaatatgcgtatcacattcaggaaaaaggagcggttgtaatggatcttaatttacgcaacgccgttattgccaatgtaaccggcaataaccaggatcagctggagcatactatcgttgacgccatccaaagcggtgaagaaaaaatgcttccgggcctcggcgtcttattcgaagttctttggcagcatgcgtcagactcagaaaaaaatgaaatgctcaaaacacttgaaggcggattaaaacctgcgcaataagcatgaaccgggtgatggcacacccggttttttttgtataataatggcgagggggatcgccatgcagttacagccggaactggcaaaaaaattgattgccgaagtcaaacatatgtacagccgcgaagtgattattgccgatacaaaagggatgatcatcgcaggcaccaacgaggcgcgcgccggatggtttcatgaaggcgcactgatctgcgcccgcgaaaaacggaatgtcatcattacgaaagaagatgaaaaacggctccagggcgtaaaagcaggactgaacctccccgttttttcaggccatgaggtgatcggagtgttcggtctgacaggagaccctgacgatatcctgcctttcggagaattgctcaggaaaatgacggagctgtttattaaagaaacgcgccatatggaagaagcgcagtggcgtgcgagaatgcttgaatcctttatggttgattggctgcagctgaaagaatggtctccgggctttttagaaaaagcaaagctcatcggcgcagaccttcacgcataccgccggatcatactcattcaaggacgttatgagcaatataaagcggaggagctcgggcggctctggcagaacgaatgccctgaagacctgtttgtccgctggggaaatgaacgcattctcattaatcatgaagcaaattcggcttccaaaacacagctcatcaaaaagatcggcgccgtttttgggcagcctgtcaccgccggcatcggacggatcgttccgggagagcgcctcgcggaatcatacgaacaggcggataaagcactttcagccggaatcggtgacaagcaggccgtctttgaagaagatttaaaactggatatgtgtattgccgatatcgcacccggcacgcggtcggaattttcacggcgggttctcaagcatgtactcggccgggaagaacttctggatacgctgcgtgcctttttcgaccggcaattatcgttaaagcgcaccgccgacgacatgcatattcatatcaatacattgcgctaccgtctttccaaactggaatcactgacaaatatgaagcttgaccatcccgaagacataacggctttttatttggcgctccgctttttagatcaacatacaaaaagtacgtaatcatatcatcatttttcatatgtttctccatagtgtgcggaatcgtttttctttacaattaaatgaaaacgcttttcttatcagggaggttgggagaacatgatttcacgagaggcaaaagaagcgttcatccggacggtcgggaaggagaattatgatgattcggcggcggggcgtctagtgtattcttatgatgcggctcctcagctgcaagccatgccggatgcggtaatcgccccccgcagcgcggatgacgtgtcccgtatattaacgatttgcagcaggcatgacattccgatcgtgccgaggggttcaggcacaaacttatgcggcggcacatgtccgtctgaaggcgggcttgtgcttttattcaaacatatgaaccgcattcttgaaattgatgaagaaaatttgacggcaaccgtccagccgggcgtgattacgcaagatatgatccgtgcggttgagcaaaaaggtttattttatccgcctgatccgagcagcatgaaaatatcgacgatcggcgggaatattaatgaaaattccggcggactgcgcggtttgaagtacggcgtcacccgggattatgtcctcggccttgaagccgtcttggcttcaggcgatatcatccgcacaggaggaaagctgacaaaggatgtcgccggttatgatctgacccggcttttcgtcggatcagaaggtacgctctgcgttgtgacggaagcgactttaaagctggttccgaagccggaaacgaaaaaaacgctgcttgcactctatgaacatattgaagcggctgcggaatctgtttctgccatcatcgctgaaaaaatcattccggccacactcgaatttctggatcagccgacactgcaggtcattgaagattacgccaagatcgggcttccgaccgacgcaaaagcggtgctgctgatcgaacaggacggtgacatcgaaacggtcagacgggatatggaaaaaatcgaagccatctgtaaaaacggagcagccatatccgtccaaacggccgaaaccgaggaagaggcattcgcgcttacagaggccagacggtccgcattatcagcccttgcccggctgaaaccgacaacgattctggaagacgcgaccgtgccgagatcacaaattgccggcatggtcaaagccattaacgagattgcagaaacatacggcctgtccatctgcacattcggccatgccggagacggcaaccttcatccgacgtgcaccaccgatatccgaaatgcagaggagatggaacgtgtcgaaaaagcttttgccgccatttttgaaaaagcgattgagctgggcgggacgataacgggtgaacacggggtcggtatcgtaaaagcgccgtatttagaaatgaagctgaaaacagaaggcatcaccgccatgaaagcgatcaaacaagcgcttgatccccaaaatctgctgaatccgggaaaaatattcgccaattcatcaaggaaacgcgtggtggtgatgaaatgacaacggctaaagagcagcaacacattcaaacagaattcaaaacccgcatggatgaaggtgaattgctgaattgtatgcgctgcggcttttgccttccttcctgtccgacctatatcgaatcgggatttcaagaatcccattcgccgcgcggccggatcgccctgatgaaagccgtcacagacggactgatcgagccggatgaagatgtcgaacgctcactttcgctgtgtctcggatgccgggcatgcgagcccgtttgtccggcaggggtcaattacggacagctgcttgaagaagcgagggatatcattcatcaaaataaaaaacataagccgggcgtgcgcctcttgcggaaagccgccttcaccgggcttttccctcatcaaaaccgcatgcaggcagccgtgaatcttctcggaatataccaaagatcgggactgcagacagccgtcagaaaaaccggtatgctgcgcgttttgcctgaacatctgcgcacgatggaacaagtgctcccgcccgccccgaaacggaaagacatgaaggaaaggccgcgttttcttcctgccgcgggtcccgtccaaaaacgggccgcttttttctcgggctgcttaatggatacgatgtttttagcgacaaatcatgcgacaacggcgcttttacaggcggccgggtgtgaaatcgcggttccggacggccaggcgtgctgcggcgcgcttcacgggcacagcggagaaaaagagatgggaaaagaactggccaagcggaatatcgccgcttttgaggcacttgacgctgattatatcattacaaacgccggcggatgcggcgcctttcttcaggaatatccgcatttactgaaagatgaacctggatgggcggaacgtgccgaacaattcgtccggaagctcaaagacttttcatccgtactggttgacctgaagttccatcaaaaaaacctgcgggcgcagtctcctcatatcgtcacatatcaggactcctgccatctccgcaatgtgatgcatacgtcagaggaaccgcgaacgcttttgaaaagcattaaaggggctgagtacagagaaatggaaaaggccgacagctgctgcgggtcggcgggaatttataatataacagagtcagagatgtctatgaaaatattagacagcaagatgaaagccgccggaaaaacggaggcggccgtcatcgtgacagccaatcccggatgccttttgcaaatgcagctcggcattttacgcgaaggattaacagaccgtgtccgcgcggttcatttggcggattaccttttggaagcggcggatttgtcataagctgatagcagagagaccgatcggctctctgcttttttatgatgctgcaatgttcggacggccgcggatttatccgggtattgaagcttccagtctggcactcggatcacgccatacattcgcccattttttcacagccgcaatgataatcacaagcccgagaatgagcatgataatggataaaacgccattcagcacgttgtatcctgccgcttcggggttcaaatacacataccgcaccatccaataacccgcatagttgacggtcacgtacaaataagcgagaggaatcaggcatgtcagcatatagcgccgcttatccgctatttttaatacgacggtcgcaccgatgattaagccgacagatgccataagctgattggatacgccgaacagcgcccaaatggaactgatgtcgcccgaatacagaagatagccccacagcaggcaggcgagcgcgcttgagaaaatcgagcccggcagccagtctgtttttttcagcggcttatagacctctccgaaaaactcttgaatcaagtaccgggcgacacgggttcccgcatcaatcgccgttaaaataaacaccgcttcaaacataatgacgaattgaaaaaagtatgaagccaaatgactgaaaaacggaatctccgtaaagatatacgtcattccgacggcaagcgtaacagcgccgcccgttcttccctccagactgagcccgatttctttgctcaattcaggcagatggacgacattcatcccgagggtgcggaatatttcaggcgtgctgttaatagcaaaatagtcggcgggctcaagagcggcagctgcaatgagcgccataattccgacgagacattccacaagcatcgctccgaaagcaaccggttttatatcactccatttatccagcattttcggcgttgtgccggaaccgacaaatgcatgaaagcccgaaatggcgccgcaggcaatcgttattgaaataaacggccagacaggacccgcgatcaccggccctccgccgtgaataaactccgttacggccgggaatttaatggcgggattgacgaaaaagacgcctgcgatcaaagcggcaaaaaccccgattttcataaaactgcttaaatagtcacgcggagccagcaaaagccaaaccggaagcgccgcggcgaaaaacgcatagacgggaagcgccactgcaagcgttttcgcatccagtgtcagcatgtccccgagagccgttgtctgcagccgcggcccgattacaacaccggccattaacaaaagaaacccgactgttgatgcgagtttgagattgcccgtttttttatagtagaggccgacccccatcgcgatcggaatcgtaatccccaccgcaaacgttccccacgggtttttctcaagcgcatgaagcacaaccatggacagccccgccatcgtgatcgtaatgataaacagcatcgaaagaccggtgcaaaagcccgccaccgggccgagctcttctttagcgacttcagaaagcgttttcccgtttttccgcattgatgcaaacaatacgacaatatcgtgcacggctcccccgatcaccgccccgattaacagccataaaagcccgggcagatagccgaactgagctgccagaatcggtcccacaagcgggccggcagcggcgattgccgcgaagtggtggccgaatgatacccacttattcgtcggcacataatctttcccatcctcaagcacatgggccggagtcggtgtctgatcattgatttttaatactttgaccatcataaaggtaccgtaaagccgataggcgatcgccaaaatacatatagacgctatgacgattgtaatcgcattcatttaatcccagccccttttctctttttctaaatattatcacaattatcagataacaggagatgatttttgcgtaaaaaaaaagccggcagcggcagcccggcttttcggaacattattttcctgataaacggatgacattccaggacagcggagtaaaatgtgccgttatcccttcagcgtttgccgaagacgttccgttggagtgaggaatgacttcttttctgtttttttgattggtcgctttcatatcctgatgctccagcacgatatgctcaatgatgcggtaatcttcaaaccctctcagtttgatctccgtttccatcagttccttgcttttgttgacggcgaaaatggtcagggcttcatcctcttcgcggtaaacggccgcggcctcaacatacggcacatccgtaaagtccgccgagtcgtatttcggggaggtgatcagcagcttcattgaagcccctctcccgtagactgaggcgtgcatgtaagggtaaaagatcggctgcctccatgcttctccgcccttttcagtcatgataggcgcaatcacgttgacaagctgggcgagacaggcgatcttcagtctgtccgcatgctgcagcatcgtaatcagcagtgaaccgatcaacagcgcatcttcaaaattgtagatgtcttcgagaatcggccgagccgtaatccatggctccacttttttatccgcttcatttgagtgataccacacattccattcatctaaagaaaggtgaatcgtttttttgctgcgttttttcgctttcatataatcacatacggctgtgacggatttaataaaatggtctaaatccatagacttcgccaaatagttctcaagatcattttcatggttgccgtaatacgtatgcagtgagatgtaatctacatgctcgtacgtatgctcaagcacctcggcctcccactcgatgaaggacggcatgccgctgtttgagcttccgcaagccaccaattcgatcgtcgggtccgtccatttcatcacctttgctgtttcagcggcaagccgtccgtattcatgcgccgttttatgaccgatctgccaagggccgtccatctcatttcctaagcaccatgttttgatgccgtaaggtttttcatatccgtgcgattttcgtaagtcgctccagtatgacccttcaggatggttgcagtattcgacgaggttccgggcggcatcgatccctctcgtcccgagattgaccgccatattcacttcggcgttcacttttttcgcccacgttaaaaattcattcgtccccacttcgttcgtttctgtcgtctgccatgccaaatcaagcctccgcgggcggttcttcaccggcccgacgccgtcctcccaattgtagcctgagagaaaattccctcccggatagcggatgaacggcacttgcaattccttgattaactcctgcacgtctgttctgaaaccgtccttgtcggctttcgggtgtccgggctcataaatgccttcatacaccgcccggcccatatgttctataaaagatccgtacatccgtttgtccacttcaccgatgatatattctttatctgctgtaatccccgcttttttcattacatttcctccctctctctatcccttcactccgcctactgtgaggccggaaatgaagtatttttggaaaaacaagaatatgatgatcaccggcagtatcgcaaaaacggacccggaaatcagcatgtcatagttgttgccgtacggactcagcagccctgaaagtccgattggaagcgtaaacatttctttcgaccgaagcacgatcagcggccataaaaagttattccagctgtttaaagattgaagaatgatcattgctccgaatgccggtttcatgagcggcgccattattctgaagaaaatgccgaattcggtgcagccgtccattctcgctgaatcaagcagatccttcggaagtccgagcgcatattgccggaaaaagaacacggcgacaggcgacacaataaacggcagaatcacccccgtataagaatcgatcaaatgaagacccaccgtcaatttgaacaacggaagcatcatcacttcaagaggcaccatcataatgatcagcacaagaacgaaaataatatttctgcctttaaactcgtagacaccgagtccgtagccgatcaaagaggaaaaaaacagcgtgagaaccgtggtgaggacgccgagcagcaggctgttaaaaaaccatttgaaataaatgctccccccgttgaacaaataggtgtagttatcaaggctcatcacatccggatcaagacgcagattcagcccgatgcgcatcagctcagatgacggctttaaagaaccgagcaatagacagatcatcggaaagatatacagcaggctcagcatgataaaaaacaaggtaaacgcgactctgtacacggaaaacatgtgattgttacgcaacgcttatccctcccctttaaacgaaccggacagtttcagtgaaacaaggctgactagtaagatgacaagcaaaagcacaattccgattgcggccccgtaccccatttcgttgtatgcaagcccctgctgatataaataaccgacaagcgtaaggccgatattgcccggggaattattctgccaaagcacatagctttcctcaaacattctgaaaccgccgatcatactgatcgttaacacataaacggacaccggctttaaaaatggaagggtgatatgccggaactttttccacgtacttgccccgtcaatttcagccgcctcatacaattctttcggcacgttttgcaatccggccagaaagtaaagaatgttaatgcccatccacctccatgacgcaagcagcaccattaaaaacatgccggtacctttgttgttgagccagttttggggtgatgcgccaagcttcatcatcagctcgtttgcaagcgacgtattcatttctccgaacatcagccggaaaataatccccgctacgatcgtcgatgttaaagccggtacaaacagagccgatttaaacacatttctgaacctgacgagcttcgaattcagaatcaccgccaaaagaagcggcaccggaatcagcacgatcagcgtccagaaagtatattccaatgtgttaaataatgccgtataaaaggttggattaagaagagcggtataattggaaaacccgacaaatgtaatttctcccggcagtatccgctgaaagctcatgataaacacgctgatgatcggatacaaaaagaaaacgagaaacgaaatgataaatggcgccgtaaaaagataaggcgccgctttttttgaatacagcacattgcgccggcgcggcttcttccggactgcagaaacggtttgcgctgtctctgtctttacaggtctcataaaagctcccccgctttcactgttaaatagggcggcttctcctatttttccaattgctctgccgcctcgtccaaggcttcctcaggtgttttttcctgcgtcttcagcgcatcgaacagcacctgtctgacaacgagatcagccgctttagagaagtcttcatgcagataaatcggattgatctcatcttttatttcaagaagcgaggaaaaaattgacgtaccgttccggaagaaatccgtgtacttgtttttctccttcaattcttttgaatcccacacgtcccagcggagcgggtcaaagccgagcaccgtccacagctttatgttcccttcctttgaacctttcgcaaatccgagaaattctttcgcgagctccagatgttcagcctgcttcggcacgacggtggctgttccgcctaaacccgctgatctgtcaccgccttctttccaggccggcatagggtaaatcgccatttttccttttaaatcaggcatataatcgataaaccgtcccatgtaccaaatgggcatcagcactgaggctgccccgccctgattcataaaaccgtagtattcttcgctgtgatggccgccgccgggagccggcagaagggttttatcatttaccatgtcctttacatcattcagtgtatctgtattcgtcttgctgttcagaatcaattttccgtttttgctgtagtagcctgacccttgctgcgaaatcatggataggaatgtggcggaatcgtttgtttcaaccgttcccatcggtttcccagcggccttacgcacttttttccctgcccgccggtaatcttcccatgtcttaatggaggcgggatcaacgcccgcttttttcatgatatccatgttgtaaaacatgacggtcgtccccacatgtgtatcaaggccgtacaattttccgtttttgctgtataaggccagacgcgcttccacaaacttatcgcggtctttttcaatcagcggcgtcagatcggcaagcgggatatccttccccttcagaaagttcgagaaccggcttaattccacgtcggctatatcgggaagcccctcacccgcgatcagcgaaaccgataaattatcatgcatttgtccataaggataaacaacggtattcagcttgattttgcgatccggatacttctgattccattctttgaccatttcctgataaaactgttcgtgcaggccgttaaacgtccaaaacgtcagctccgtttctcccggccggccggcagtccgttcttgtgaacagccggcggtaaacaagaagagcatcatcagcaccaaacatacagcggttgtttttttcatgtcattaccccttccactttaggccgtgcggctattgatgcaaatgatgtgcaaagagcgctgcattttcatttatgatggttaaaccggtataacggtctcgcagtgtgtgcgcatgcttaagcgcatcgctgacaaggtccttttttacaccgatctcatcgaaacaggcgggacctcccgcagatgagagccacccggcaattgttttgccgtcgggaagcccttcatatgcggactgaatcgcctcgcgaaagtgcggcggcagttcagcaagcttttcgtgacaagccagttctttgtaaatatcactcagcaccgcgcacgcacagccgaccttcgcaccgtggagaatcggaggctgttttgccttcagcatttccatctcaatccaatgcgagatgtgatgctctcctcctgaggcggggcgggagtggtcgagagcaagcatgacaagacccgaaacgatcagcgcttccatcagtatctgaatgccggcctccgttcccatggcaatgtcagcgcggtgatcaatgcactgccaaagcgcgtctttcacaagcttcgccccggcttctgagtacggctcacccgcaagactgcgggaaatctcccaatctgccagcgatgttatttttccgagcatgtctccgaagcccgcggctgtcattgaacggggcgcttcttttaatacattcgtatcggcaaataaggcgatcggtgctttcgtttggatcgtcgttttgattccgtttaatatgagcggcgctcccgccgatgtaaaaccatcgactgacggagcggtggggaatgagataaacggcaaaccgcgctgataagcggcaaaccgcgtaatgtcgtgaatcgttcctgaaccggccgcaatgatgacatccgtctcttccgcgagattgatcagcgtatagaccaatgtcctctcatcagccgcggcggccccggcttcatgctccggaatgatgacttttgatgctttgattccgcctgcccttaattcgtccgcaagcagacgtcccgccgcctcgtacgtgttccggtcacagacgaggaccggatgattccagcattttttttgcagaaatctgagaagctcttcttttgcattcgccccgatcacgatatcttctatttgaatcggtgagcggctggccccttccttgtcaaactcggattgaatgtcctcaggagaacgtttcataaaaggattccctccttcgctaattctgtcaggtctttaatagaatcaaggacgatgtcaggttcatatagacggggctccccaagtttggccgaccccgtcagaaccaatacgcttttcattccgtacagcctgcccattgcgatatcagattcgaggctgtctccgataatggcgcattcctcagggggaagtccgagcgcttcacatgccgcctcagccatcagccaagacggtttgccgatgacaagctccgtttttgctccggcggatgcttcaatggccccgatcattcccgcgacatccatggcatggccgccttcattcggaaaggagcggtcccggttcgtggcgatgatgcgcgcgccggaggaagccgccttaaaagcgagattcagatcctcataggtgacggtttcatgcagggagatgacaagccagtctgccgcctgcgggttttgcgccaggacgacacccgctaaagcgagttcatcagtcagccctttctctcctaacacccagacctttgacaaaggataatgcttctttaaaaatgatgccgtcacactggaggacagcacgatgctccgttcatccgtgcggatacctgcacccagcagtttctttcggcacattgctcttgatagattgccgcggttgcttaaaaagacaacggctttgcccagtgactgaagggtatgaacggcttcttttgcgccgtcaatcagctcccgccccctgaatacggttccgtctaaatcaatcagaaacccggctgcgtcaagtttggccataataagcattcgccccgtgttttctgtaaaaatgcttatcatgcagcactctgtcgatcggactgagctgtttgttcagcataagcgaatggtaggccatttccgctaccgtttcgagcacaacggcgttatgcagggcattcagcgcgtccgttccccagcagaacgggccgtggctgtggacgaggacacccggattttgttcatacggttcgttttgaaaggtttcggctataactttgcctgtatgatactcgtaatctttcacaatttcttcttcatacatttccctcgtgcagggtatagcgctttcaaagtaatccgcgtgagtcgttccgagagcgggtatgtctcttccggactgcgcccagctcgtcgcccagcgggagtgagtatgaacgattccgccgatagccggaaacgctttatacagataaagatgggtcggcgtgtcagaagacggtttcagcgagccttccagaatgtctccgtcctcattcagaacgaccagtttgtcagcggtcagctcactgtaatcgacaccgctcggtttaatgacgattctcccgctctctctgtcaatgccgctgacattcccccatgtaaacgtgacaaggttatgttcctcgagcttcagattggccgcgagcacttcttcttttaacgcttcaagcatggaggctcccccctttcgcaaaatcgcggtttttaatggctttcaggcgtttcatgacattgttttctttgccgaagtagtgtacgagctctttatattccgcatataagctgtcataaatctcagctctttcccggttcggggcataaaagccgtcttttaatttccccatatgtgcgcatgcttcagcaatattggagaatcccccgttttcccgtcccgcggcgagcgctccgaaaatcgcggagcccagtgcaggcgcctgcggagatccggataattgaatgtccatatttgtgacgtctgcgtaaatctgcatgacaaactgatttttttcggcgattcctccggctgcgtaaagctcttcgaccggaacgccgttttcccggaacgtttcgataatcatcctcgttccgaacgccgtcgcttcaatcaatgccctgtagatttcttcgggcttcgtgtgcagcgtcatgccgagcatcatgcccgtcaaatcggcgtccaccaaggttgagcggtttccgttccaccagtcaagcgcgagaaggccgctttcccccggaacaagttctgccgcttttttgctgagcagctcgtgaatgtctatgtgtttatcctcagcttccttctcatagtctctcggaacgcacgttttgacgaaccattcaaagtggtcgccgacacaggactgccccgcttcatatcccgcatatccgggcaaaatgccgttattgacgaccccgcacataccggggacgatatgttcttcctcgccgagcagcacatggcaggtagacgttcccatgatcatcagcattttccccggctctgtaataccgaccgcgggcactgacacgtgagcgtcgacattggcgacggcaacggccgtccccggcagaagcccggtcagctccgccattttttcggtcaaacctcctgctttttccccgactgaataaatcgtgccgcttaatttatcctttgtaatcgttttcattaacgggttgagcttttcgaaaaaatgatccggcggatatcccgtctcctcattccagattgctttgtagccggccgtgcagttgcttcgcttcaatgaaccgcacaattgatagacgatccagtctgccgcttccacaatccgatctgccgccttgtatatatgcggcgcttcttccgcgatttgcatgattttcgggatcatccattcagaagaaattttaccgccgtatcttttaaggaatggttcctttgtgtcttcggcaatcgtgttcaaacggtctgcatgtttttgagccgcatgatgcttccacagcttcacataactgtggggctcccgttcaaattccggcagcatacaaagcggctgccccgcgccgtctatcggcaaaatcgtacaggcggtaaaatcaattcctatgccgatcacgtcttttggatcagcgcccgcctgctcaagcaggttcggaatcgccgtttccagaacttcgatataatcggcaggatgctgaagcgcccagtcccgagggagtttttcacccgtcttcggcaacgtgcggtcgatgacggcatgagtgtattcttttaccgcagacgcgatttcttcgcccgtgcggacattgacaagcaccgcccggccggacaatgtgccgaaatcaataccaatcgtatacgccatatcaattccctcccagccggtataatacgtcattccatttcagctcttttttcagctcatgtatttcggtattgcgggaaataaagatgctttcaatgcctgccatctcagcccagtcaagcatctgttcagccgtaagccggaaggacatacaggtatggtgggcgccccccgccaaaatccatgcttccgcagctgttttcagtgatggctccggcttccacagcacccgcgccacagggagattcggcatatcatgatcaatttccctgccttccgcttcattcagaatgagacggaatcgcccgccgatatcaatgatgctggcgatgatggctgaaccgccgattccgttaaagaccagccgggccggatcttccttccctccgattgagagaggatggacttcgattttcggctgatcaagagcgatcgtcggacatacttcaagcatatgtgatccgagaatcatcgcatgacccggttcaaaatggtacgtataatcttccatgaaggaggtttgttctccgtccgccattattttcatcattcgcacaagggcagccgttttccaatcgccttcgccggcaaatccgtaccctttttccatgagacgctgaacggcaagacccggaagctgcttcattccgtgcaaaacttcaaaggaggtcgaaaacgctgtatatccgccccgttcgagaaaggccgttaatccgagttcaattttcgcctgttctttaatggcagcaacttttgcttcatcccgcttcgtttcgtcgctgatgacatacaatttgtcgtattcctcataaagcgcctcaatttctgcgtcggtgacattgttcatcacctcggtaagatcgccgattccgtacccgtcaacctgccagccgaattgaatgtgggcgccgactttgtctccgtcagtaaccgccacattccgcatattgtcgccgaaccgggctactttaatattcctgctttcattccaagcggcagccgtgttcatccattgcgaaatgtcatgtttgacttcctcatcatcccaatagcctgcgatgacttttctcgtctgccccattcttgactggatatatccgtattcccggtctccgtgagcggattggttgctgttcataaagtccatatcaatcgtttcccacgggatgtcgcggtgatattgggtatgcagatgaagcatcggcttttgaaaagcagaaagaccttcaatccacattttcgcaggggaaaatgtatgcatccatgtcacgaccccggcacagttttcttgatactgcgcttcccgcaaaacctctctgatcgtttcagatgacgtgacaaccggtttatgcctgatcttgtatcttgatgacaccccgcagagaccgtcacatattccctttgcgtgtttatcgacaagctgcagcgtttcctctccgtataagtgctggcttcccgttacaaaccaaaattcatattctttgttctgaagcacattcatttccccttcccatcaaaataaagcgcttgcatttttaaataaatatacgtacgaatataaataataaaacttttattcttttatttgtacgaacaacttcattatagttaaggaggaatcaaactgtcaatcttttattgcaagtaaaaaagccggacacacatgcccggctgatcaattaataggaaggccagcctgaactccaatcgatatcattgatgagcatcttcggaattccgctgttttcggcatcatacgcatgacgcactaaaatattcccgttcacaatatcttgaccgcccgggcctttccagcggtcattgccggaatcaagaatcgtccctccgccttcagacatgcttttcccgcttttatcgagatatgggccggtgatgcttttggatcttccataagcgattttgtacgtactattcacgcctgaacagcatttatcaaacgacaccattaagtaatagtagccgttctggtaggtgatggccggcgcttccaaagctccgccgttattcggcctggcagcgatggaataaagtgatcccgtcggtttcattgtatttttatcaagctttgtcagcttaatgccgctccaaaaagaaccgaaggcaagccaggggtttccgtctttatcaattgtcagctccggatcaattgcattgtagttattggcgcttgttgaacggatgacgagcccttcgtccttccagtttcccgaactgagacttgtagatgatgcaagaccgatcgcggaggtatttttgccgaatgaagaaacggcataatacagccaatactttccgttaaaatattgaacatcgggggcccattgattcagcccgtaattcggcacataattgccccaccatgacagcggggaagtaaagattgatttctgaacggtccatacgccgccgctgcccgcctttaagacgcgaagccccctctccccttccaaaccggttccgaaagcgtaccacgtgtttccttccttcgccattgtcggatcatgaagcaattcatttgatgccccccaaaacgcggcagatgccggagatgaagacatcagaagcagaccggctgtaacggctgcgcatgaaaagcggatcatgcgtctgaatctgtttttcatttgtaaacctccctttttttaaagcgctttcaaaaaaacatgttgtcagatttttctatgtcttttcttattgtagacgcaaggctcatatttgtacagacaaaaaaaagaatctgcttaaaaaagcagattcttccgtatctttattgataagtaatacggtcaaccgtttcccggtctaattttttaatcacttctgtgatcaattttaccgtattctcataatcatcccgatgcaaaatagcggcatgagtgtgaatgtagcgcgtcgcgatcgtaatggacagcgccggcactccgtttgcggttaaatgaatagaacctgaatccgtgccccctccggcaatggaatcgaattgatacggaattcccgcttcttccgccgtgtttacgacaaggtcgcgcagccctttgtgagataccattgacgcgtcatacagaataatttgcggcccttcgccgattttgctttgcgcctctttttcagaaattcccggtgtatctccggcaattccgacatccacaccgaacgcgatatcaggctggatcgtatgtgccgctgttttcgccccgcgcagcccgacttcttcttgaaccgttccgaccccgtatacttcattcgggtgatcactgtttttcagattttttaatacatcgatggcaatcgcacagccgatacggttgtcccacgctttcgccaataaatgcttttcattgttcatcactgtaaattcaaaatacggcacaatctgatcacccggaagaacgccccattccattgcttcttcacggctggacgccccgatatcgatgaacatctctttaatatcagcggctttttttctggcgtcaggaggcagaatgtgaggcggtttcgaaccgatgatccccgtgatgtcccctttttttgtcacgacggtgacgcgctgggccagcatgacctgagaccaccagccgccgacggtttgaaagcggagaaagcctttatcagtgatttgcgtcaccataaaaccgacttcgtctaaatgccctgagatcatgattttcggaccgttttctttgccggtttttttggcgattaaacttcccagccggtctgttgtgacatcatcggcaaatggttctatgtatgatttcatcacttgtcttacttctctctcatttcccggtatcccttttgcatccgttaacgctttcagcatggtgagcgtttcatctaattttgtcatcaataaacctcctttttttcactacccttcttattatacaaaaccaatgctgaagcatacgattaattcgcctgaaaaacgggtaaatgtttttatctatttcttttaaaaaaatgaaactttttgttttgtttttcgtattacatcagatcatgacaaaggtgaggaggtgccttcacacatatggccattacagtattgaggattgtcttgcttgcacttcttatttattttatttacatgtgcgtcaaattttacgcaaacccgaaaagaaggctcagactggcgcaatcaaaagagaatttttattttattgacgaacagaaaaacacgcgaaaaaatctccagcttacttataaaggagtgctctttgaaggagaaaagcatatcccttccaaagatcatccgctgtttattcatacgatatttgtatggaccgaaaatccggaaaagctgaaccgcttttctgcaggtgattttgaagaagtcgaaaaaaaggtattggagcggtacccgaattgcaagattgattgggaccagcccatcaaaaaagcgaaaaaagcaggcgagcgataagctctcctgctttttattttttatacatcaaatacatgagcataagggcggcttcagtgagaaaaagcagcggcaccccgtataaaaaggatttgtgcttcgtcttatgcctgaaggtgcgcatgccgatccatacgccgagtgagccgaacatggcggctgtgagccatattcgtttctctgatattctccacctgtgcgcctttgctcttcttttatcagcgcccatgatccaaaagccgtatccgtttatcaatacggcgtaaatgaagagagccattgattgtcaccctttacgtaaaaaaaccgctcccggaaagagagcggctttttcaacttacttgtctaactgagctttagcagcatcagcaagctgattgaaagcagtaagatcgtttacagcaagatcagcaagcattttgcggtttacttcgatgcctgaaagcttaagaccgtgcattaaacggctgtaagaaagaccgttcatacgtgcagcagcgttgatacgagtgatccaaagcttacggaaatcacgttttttctgacggcggtcacggaatgcatagtttcctgatttcatgacctgctggtttgctactttgtataatgtatgttttgaaccgaaataaccttttgctaatttaagaacctttttacgacgcttacgtgtaacagttccgccttttactcttggcattagatttccctcctaattgttccttgtccgattacttgatgttggcaagctgttgtttgatgcgtttgaagtctcctgcgctcacaatagcacccttgcgaagcttacgcttttgcttttgggatttgttggcgaataagtgacttgtgtatgcatgagaacgttttaacttcccagaacctgtctttttaaaacgtttagcagatccgcggtgagttttcatttttggcatgggatttcctccttattgcttttcgtttttcggcgcgagcattaagaacatgctgcggccgtccatttttggttttgtttcgactgtcgcaacttccgcacatgcttcagagaaacggtccaatacgcgctggccgatttctttatgagtgattgcgcgccctttaaagcggatagaagctttcactttatcgcctttttcaaggaatttaatcgcattgcgcaatttcgtgttaaagtcatgctcatcgatcgtcggacttaatctaacttcttttaagttaatgattttttgatttttgcgtgcttctttgtcctttttctgctgctcgaatcggaacttaccgtagtccatgatgcggcagacaggcggttttgcatttgctgcaactaacacaaggtcaagatttgcgcggccggcgatttcaagtgcttcctgacgggacttgatgccgagctgatcgccattttgtccgatcagacgaacttcacgtgcacggataccctcattaaccaattgatctttgctaataatgagccacctccatagtttcttcgaattgattcacaacgctttttgactgcattctgcaggcaaacaaaaagtgcgggcatgacaacacacccacactacgaacatctgcataaataaaaatgtacggtcaacctgccaactacatgaatgtgtcaatcaggtgagaagcgggtgcctctgcttgtgatttatattcaattcaataactattctacacaataccggatcattagtcaagaatgacttctccggatcaactttctcattttaacacgatgccagtgtgagcgcaaggaaaaatgtgaaatttcgttctttgccgcccgcggacgtgccaacacaataaaaaacccgggtctatgacccgggtttatcctccgatgagctgaacgaataccggaatgaccagcaccgtcaccactcctacgacgacaaccgcgatacttgccattgccgcttctacttcccccatctcaatgccgaccgcaacaccgagtgcgtgtcctgatgtgccgagagccagtcccttagagattgggtgctttactttaaacagttttaagaatagagcgcccagagcatagacgataacggcgttgaaaataacggcgaaagcggtgatgtcggtgatgccgccgatcccttttgacagcggaagggcaattgccgttgtcgccgcctgcggaagcatgcttttcataacggccgcgtcgagatgaatgccttttgcgatcaaatagacaatcgtgactgagcagatagagccgacaatgatggaggacataatctgccaccagtattttttcagcttgtcacgctgtttgtataaagggatggcaaaagcgatcgtcgcgggctccaggaagaatttgataatgtctcctccgcttttataatcttcatatgaaaaaccgccgagcttcagaaaaaggattccaagcaccatcgcgacaaacagcggggtgaagaggaaaaagcctctcgtttttttaaataaatacgtgccgatgccaaaggccgcaagtgaaacgacaataccgaaatatggactcatccgttttccctcctaatgctgcacaagttcgttttcctgattggaacggcgcaccgtttgtttatcagccggagcagccttctgacgtttttggctgacagacaagatcagctgagaaaaaaggcccgtcgcccctaacagaatgatggtggcgagtaagatgacgagtgcgatctgcacgccgtactgctgcatgacgccaagtgaattcatcacggagatgcccgacgggacaaataaaaatccgatcagtgacgttaatgatgttcccagcgtttctacttgttcaagcttaatcactttcaggcataagaggacaaataataacaccaaacctactacggaagcgggtataggaatggggacaatcgctgcaatcccattagatatgagcataattacggcaaaaataaatgcttgtgtcagaaatccgtacacttttttcgcactcattttcttcacctctttctctttgttaggtccattataaaagagaaattgatttttaaagcgctttcataacaaacggctgaatattcattctgaaatgcaaaaaacggctgctgaaatgcaaaagccgcctcatataatatgaagcagcttttttaagtccttggcgtatgtacggctgacgggaattttagagccgtcttttaagatcagattgtaagtcgaattaaaccacggatgaatttccgtaatatgctccgtattcacgatgaacgcgcggtgcactctcaagaaacccgtatcaggcagttttttctcaatgaccgccaaagtttcatgaacggaataagacgcggcaaacgttttgacggaaacgtgtccgtcctccatgccggcgtaaataatgtccttcgtatctaaaatgacaatagattcaccggctgatacagccagtttatgcgctccggctgcggacggctgctccgagacggctcctgccctgtccagcttcactcttttaaactttctgatcgtctggcgcactctttcttcatcaaaaggcttcgttaaataatcgagcgcgtcgacttcaaaagcttttaaagcaaattggtcatacgccgtcgcaaaaacgacggccggcggatttttcatgtttttcagccgtttggcaatgtcaaatccgttttctcctgacaaatcaacgtccaaaaacagcagatccggtttttgatccatcatactgtcaaaagcggattcaatattttcagcttcgtttatgtcacttacttcattcgtccgtttcagcaaataagctaattcatctcttgccagcatttcatcatcaacgattaacaccttcagcatgttcttctcctttagtcatcagtttcaaaggcagctcaaatgatacgtccgtacctttgccggcctcactttccaatcgcagggctgcttgtgggccgaacagcccgatcagccgctgatttaaattgtaaagcgcggttcccgtcccttctttagacgggagcggacggtttccgagcacggacagcaattccggatcaattccccgcccgttatctccaacccgcattaaaaccgactgaccggcggataccacgctgacattgactgcacagctgtcctgctttcttgaaaatgcatggcgaagcgcattttcgacgagaatctgcagcacaaaaggaggaatttcgatgtcctccaaaccgcgttcgatttcaagactgattttatatttcccgggaaaacgggcctgctccaatgataaatacgcctgcagatggttcagttctttagaaagcgggatgagcagctgccttgctccctgcagattggaacggaaatagacgctgagctgcagcagaagctttcgggttttttccacatccgtacggcaaagtgcagaaatcgtattgatcgcattaaacagaaaatgcggattgacctgtgcttgaagcgcctttatttctgcgtctttcagcaatttgctctgcagttccgcctcgccgagttcaagctgagtggaaaacagcatggcgagtccttctgcaagctcttcttcaacccggcttaaacctgacgggcttttaaagtacattttcagcgtcccgatcgttttgccgtttgacgtcagcggcaatacaatcgccgcatgcagcggacagggatcgtgcgtgcattcaatttcttcctttgatgtcgctttcataatatgacccgttttaatgacgcgttttgacaatccggtgatcaggctttcagacggaatatgatggtcggcacccgcgccgacgtgcgccaaaatcttttcgttatccgtaagcgataccgcgtccgttcctgtttgcctgtgaatgatggcggcgacgcttttgcatgagctttcattcagtccctggcggaaaaacggaagcgtctgatcggcaatcatcagcaccctatgggtttcaagggctctcgcccgttcttccttccggataatcgactgaatgatcgaaagaaaaataaaagtccctgacccgtttaccaatatcatcgggatgccgatgatgctcacaagcgtccaagcatcagaaaacggcttggccatcaagaggatgagcagcatttgcagcgattccattccgagtccgacaagcgcggccacacgcggtgtcggcatcgcatagcgttttctgaaataccgtccgatccagccggacaaaatgcccgctaaaacggatgagacggcacagctgactgcggtcgcgccgccgagtgataaacgatgcaggccggccagtatgccgacgccgattcccacatacgggccgcctaagagtccgccgatttcaacgcccataattcttgtattggcaattgaaccggacggattaatttgaaacacccagtcattattcatgattgtattccgctgaatttctattcccgtatagttgctgatgatactgaacagcgagaaaattgaaatcagcaccgctttgcctttatagctctcaggctgctggagcgcctgtctgaacaatctggtatgagccagaacaaatcccaatatgacgataattccgactctttccagcatcatgatgatcaaatgcagcatacttttcacctgttctttcaaattgtattttatcacgttttagagcctgagacagaatctgacacaaacctgcctgtttttttcaaatcatctgaaaacatctttcacagtctatgtatctattgtagaataaacgggagccttgcggcagagagtttcagaatataacaaagaggagaagatcatgaaagccgtattttttgatttggacgatacactgttatgggatgaaaaaagcgtcagaacaacattcagggaaacatgtttacaagcggaaaaaaaatatggccttgacccgcatacatttgaagaggcggttcggaaagcggcacgggaattgtatatgtcatacgaaacctatccttatacggtcatgatcggcattaatccgtttgaaggattgtgggcgaatttttccgagccggtcagcgaaggatttaaacagctgaatcggattgcgccggaatacagacgaaacgcctggacgaacggcttaaaaagcgtcggtatagacgatgcggcttacggcgaatatttggcggagtttttcgcggcggaacgcagacagcgtccgtatgtgtatgatgaaacgtttgcggtgcttgataagctgaaaggtgtttatgaattgcttctgctgacaaacggcgatcccagcctgcagaaagaaaaactcgccggcgttcctgagctcgcgccttattttaatgaaatcgtcatctcaggcgctttcggaaaagggaaacccgatgcctccatattcgaacattgcctcggcctcctgaacctgaaaaaagaagacgccatgatggtcggagataacctcaatactgatatattgggagcgaaacgggcaggcattacgacagtctgggtaaaccggacgcaaaagaaaaatgatacggacattgcgcctgattacgtgatcagcgatcttcacgagctgtttgcgattatagagaaacaaaaagaaagataattttatacgctaaaaaaccccattctgaatgaacggggtttttgtatttccggttattttttcgcttcggctacagcctttttcacaaaatcgtccaatgagacggtttctgatttctgctcgccgtatttccggacgtttaccgcgccgttttccgcttcttggtcaccgaccacaagcatgtacgggattttttgcatttgcgcttcacggattttatagccgattttttcgtcccggctgtcaagctcgacacgcaggccttcgcgctgcaggcgctcctgcacttttttcgcatagtcaagatgcacggacggtgatacaggaatgacttggaattgcaccggcgcaagccatgtcggaagggcgcccttgtgctcttcgattaagaaagcaacgaaacgctccatcgttgacacgactccgcggtgaataacgacagggcggtgctgtttgccgtcttctccgacgtaagtgagatcaaagcgttccggaagaaggaagtcaagctgtacagttgacaatgtctcttctttgccgatcgccgttttcacctgcacgtcaagcttagggccgtaaaacgccgcttcgccttccgcttcataatagtcgtgccccatctcatccattgccgccttcagcatggattgcgctttgttccacatctcatcatcatcaaaatatttttccgtatcttcaggatcgcggtaagacaggcggaatgtgtaatcactcaggccgaagtcttcgtatacgtcttgaatcaaacggacggtgcggatgaattcttctttaatctgatcagggcggacgaaaatgtgcgcgtcatttaacgtcatgccgcgtacgcgctgaagacctgaaagcgccccggacatttcgtatcggtgcatcgttcccagctctgcaatccggatcggaagctcgcggtagctgtgaatgtcctgtttgtaaatcatcatatggtgaggacagttcatcggacggagcacgagtgtttcattgtccatttccatcggagggaacattgtatcctgataatgatcccagtgccctgatgtttcgtacaggtctttgcttccgaggacaggcgtatagacgtgctcataaccgaggctcagctctttatccacaatgtagcgctcgatcacgcggcggatggtcgcgcctttcggcagccagagcggcagaccttgtccgactttttgagagttggcaaacaactttaattctttgcccagttttcggtggtcacgctctttcgcttcttcaagcatgcgcaaatgctctttcaagtcatcctttttaaagaaggccgtgccgtaaatgcgctgaagcatttggtttttgctgtcgccgcgccagtatgcgcccgcaaggctcagcagcttaaattctttaattttgcctgtagacggcacatgcacgccgcggcacaggtcaaaaaattcgccctgctcataaatggagaccgtttcgtcttctgggatggcatccagcaattcaagcttcagattatcgccgatttccgcaaacatggcttttgcttcatcacggctcacttcttttcggatgatcggcagattttcaccaatgatgcgtttcatttctttttcaatcttcggaaggtcatccggcgtcagcgcctgctccatttcaacgtcataatagaacccgttttcaatgacggggccgactccgaatttcacatctttataaatgcgtttaatcgcctgggccaataaatgcgccgtgctgtgccgcatgatgttcaagccttcttctgtgccttctgtaatgatttctacggcaccgtcctcttgaatcggcgttcttaaatcaatttcctgtccgttcagttttccggctaaagactttttctttaatcccggactgatggatgccgcgatatcttctgttgttgttcctttcggaaattcctttaccgctccgtccggaaatgtgatgttgatcatatctgacatcttcgtcactcctttttttatgcaaatcaaaaaccccgccccctatgaaagggacgaggttaaataaacggaatcgtggttccacccttttttccgcgcggccgattgtttcggcacctgcggctctaaactctgtaacgggagttcccgtcagctattactggcgcttattccggcgttcacagctgaagttcaaaggcggtaaagacaatgatccatagctggaaagctttcagcctgggctctcctctcttataaagccggtatcaatgcttcatgtccttatcaatacgtgtagcaatcattaatcttttatgtattataaaatgtctgtgagaaaaatgcaactcggttttccgtctgatttcgcacagacagccctgccgcttacgcaaggccgtccgagcggctatccttccgtcttctcggctgcaaacgcgcccagcggaaaaaggcgcaccctctcctgaaacacgttttgaatcgttctggacatcatatgttccggtttgtccgtatacagttcgaccgtctcaggcgcaatggagatcagcggcgcaaggagatgggaatctatatacatcgggtgctcccgcacaaaccgtctgtctatgtattttttctgttcccgttctgacacatagcgcagctcccacagcgtaaaagcccgttcatgtacgatgcggactttcttcatccgcggcggattggatgtcacataatctctcagagactggataaagttttgatattcctgttccatccggtattcatctatcgcagcctccgcgtattctctgagcctctcataatacctgccgagccggaacgtctgaaacgaacgcacggaaaaaacacccgcatcaagtgaaatcgtccggagcgcatctgaaataaactgtgcgcgcggctctttcttcggctcaaacggatgatcctcaagctctccttccataatgctgtgtgcaagctgaaggatttgctgctgttcatcctgatcggtgaagcagtatgcgtcctcaataagcgaaagcatatgctcgtcttctttgcattccaaaaaaaacctgacaagtatcggctcaataaagcgctgaacgcaaaaagccgtttcagaccttgcgattccgactttttttatgccttcacggacaataaaatgtctccggtcgtccgattgctgaatgagatgtaaaaaagcggcggtatcgtggtcatcttcaaagatcacttcaagcatatttgtcccccttacggcatctgttacaagtatatgggggatgtttttaaaatagacgtaaaggttagctttcaccgccgaacaaatgacgcaccttctttttaaatataacgggaagcgataaaaatacgacgtaaagacagatcacgcagagtacggtcagcacattgccggacataaagctcgcgccgagcacattcaggacgatcgtccccggaatgatgcccgctgcggtcgccaaaaaatacgttaccggcctgactttcgataggcccgcggcatagctgatcacatcaaagttaacaggcagaatgcgcaggataaaaatataaaagaagccattggttttcatctgcttttgaatggcttccatttttccatgacggcttttcacattaaaggcaaacagccccgccgcaaaaaaagacgcggcggcagcgcccattgagcccgccagcgtatacatggtgccgaaaaacgggccgaacgccaatcctccggcgacggaaacgattgatacgggaaacagcacaaaaggcctgacgatggaaattccgataaacacaagcggcgcaaaaacaccgaacgataacacccacagccggatctccttaggcgacagattcagatatttgcggtttgcccacagcaaaagacccgctcccgccgcagccgcagcccaagtgacagccttcttattcctcattccctcaaatccttcccattggacgccggcatcatgaacggcggcggttttccccgtcaagacggacgggcgaagccaaatataaaatccgctccatcagtcttgccgcttttacttcttccttttctccccgctgtgaatacgtaaaatgatgcttcagctcgtctggtgaaaaattagacgagaagaaagtgggaagctgctggctcattctgtgctgaagcacggtgccgatgacttcatccctgacccagcttgtcattgattccgctccgatgtcatcaagcatcagtacgggcgtcgttttcaccatattcagtttcgcctccagcgactgatcctggagcgagtttttcagctctctgacaaattcgggaacatatacgatcattgatgaatactctttttccgccagttcgttggcaatggcggctaaaataaatgtctttccgattccgaattttccgtacagatacaggcctttgccttttcccgtttcattatagctcttcagaaaatccgtcacatgctggaaaatgccgagtctgctcggatcggtaatgtcgatctgctgaaacgtcgcgccgagaagatcctgctggatatacatgctcttcatcagggacttttgccttttctggcggtcgagctttctcttttccggacattcgtaatattcaatatcaatggaacgcccgttgatcacaagcttcggatggtagccttcaagcaggctgttcgtccggctgtctttcgaacagaaggcgcactgtttgctttgctgaacgaattcgtacagtttatttaaccctctgtcaatcatgctttgattgattacatctttctgttccttcaaaaaagcctggacgtcttcgtcggccatgacttgctgctgcattcgttccaggcgtttttgaaagtcaggtcttttcgtcacgccttctaaggatcggctgatcggttccattcaatatcaccccgcttctctgtctcaataggcagagtattttttcagttttttcatttcttccatcatttttttcttctgtttttcaagatcctgtgcggaaagagccggctgttcttgtttcttcccggtttcttctttcatccaatcagggcgcttttcttcccggacggtttttttgccgcgcgccgcgccgtttgttttgccgtccgcccaatcaagatattgcctgtgctcttcgattgcgagcttcattgcttcccgtaccgttttgactttctttctggcccagtgggcggcgattttttggatatagtttttggacagcttcatatccgttttcagcatgacataataaatcagcacattggtgacgccgggctcaagcttttgttcgaacataatatcggcgataatctgcaggtcggcttttgacggctcggtcccgtccgcaatgtcctgaagaagctttctcggtgatatggtctcaagctgtgcgatgagttcgccgttcaatgaatcgtccttttccgtccgattttctctcaaggtgacaggctgtgttttatcaatcagttcgggaagcttgccgcttctttcaatttggtaccagtcgctggccgctttcctcagcgcttctgccgttatcgtatcctgttcattaattgcggtcatgacgacgtgctgcatggagataggatctattccgtataaatatgaaagctttttaatgctctcccgcacatcctgtgtgattgatttgcgcggtatcatcgtttctgataaccccgctaaaaacagctcaaaatcaaacacttcctccgtcaccgtataggaaggcgcttgtccgacagacgccgtctcatagtcctgggggagcttcatcgcctcttccatatcaggcgtcattttccattcactcggctgaaaagaggcaaaggcgtgattaaacggacgggtaatttcccttgcgcccgcgccgacggaagggtgcgtgtaaaattgtctcagctgctggtatttcgttttaccgactctgttataaagaaagacattcagcatgccgtcttcaaaaaaatcattcggcctgagcgggggcagcagctcataaataaacatccgctctttttgctcggactcccggatatacactttcagcagcccgattccttcaagctttccctgttcatgatgaatcttttttaaatttgactgcatcatgcccatcagctgcctgtgcgtggattccgctccccacaagcggttctgctcaagctccccccacaaggtcatataaagggagaatgcaaaagaaccgatcagcggctggtacagatgtgtcaaaacctgtctgtcgacatcctgaagaagcgaacggcttttgaccgtataaggatctacaggcaatacgtcattccaatagtcagccatgattctcaaaccttccgatatgtttctactctcattttacaccgtttctgcgatctatcaaatgccaattttgctcatgagaaaagagccagacacaatctcttagctctctcagcgttctttctttattaaatctttcaattcatcgataaacacgtttatatccttaaactgccggtagacggaggcaaagcggacataagacacctcatcgattttcgccaggcggtccattaccatttctccgacaagttcgcttttgacttcagatacgccttggtttctcagctctttttcaatgtcaaagcacatgtcttccaatgtttttaaaggaacgggccttttttcacaagctttaattaacccgcgcagcattttttcacggctgaattcttcccggacgccttcttttttcacgacgatcagaggcatctcttcaaacttctcaaatgtagtgaagcggtaatggcaggcttcgcattcccgccttctgcggattgatttcccttcgtccgcaggccgtgaatcaagtacgcgggaaccgttatgctggcatgaaggacatttcaaattggatcagctcccatctgtttcgttgctgtaatgcggttcgcaagcttccggtaaatgcccgccaacgtttctaggatgagcctatttgttgggagagccgatagaccggccttatcttttctattttacaaaaaaaatgcttaaagaaaaagcaatgctgtttttttacattagaaaaggagcatcagcttcaaagcgcgtaatggctttttcagcttagctcccttgtgtttgcgttttgaaaattacagtactttcgcttgtgcctgtttaatctgtacaggccccattcctctcggtatttcaatgttttctcttgtatctgcatgtaatgcgtccgcaatgtaatccgcagccacattaggatccaggtctccacaagtataaacatcaatgcttgcatatccgtgttcaggaaaactgtgaatcgttaaatgtgactcagagataataacgactccgcttacgccttgcggtgcaaatttgtgaaatgcgacctcgcgcacttcagctcctgatttcaaagcagcatttacaaacgttttttcaataaaatccatgtcattgagcttatcaaaatcgcatccccacagctcggagatgacgtgacgccccattgtttccataatcatggaccccccttaacaagaattaaaaaagtgaatttccgagaactgacccggccatttaccacgggggaaagttagtccggagaggtcctaaccctttaagtaattccgaagcagtcacgagcaagaagttcacgaaagatagtatactgtgtttaagtttattttgcaaggtgtgttttttgcgaatatgccgttaagggtttttttctaacaaatgtccatgatctttagtctacacagctgacgggtgtttcattcgcgcggcgacgtgacggataagatcaacgacccggcaggaatatccccattcattgtcataccaggcgagcacctttacttttcggtcttccatcaccatcgttgtcagtccgtcgatgatcgcagagtgtgaattcgtattataatccgaagaaacgagcggctcatccgaataatcaagaattccgtacatcgacgtttttgcggctctttggaaagcggcgttcacttgctcggcagacacatctgttttcagatcgcagacaaggtccactaatgacacattcggaacgggaacacgcaaagcaagaccgtgaagttttcctttcaaatgaggcagcacgagcgacagcgctttggcggcgcctgtagaagtcggaatgatggattctccgcacgctctcgccctccgcagatctttatgcggattgtcgatatttttttgatcattcgtgtaagcgtgaacagtcgtcatcaggccgctttcaatcccgaattcctgatcaagcactttgacgaccggcgcaagacagtttgtcgtgcaggatgcatttgaaataatgacatgttcatcgggattgaactgctcttcatttactcccatgacaatggtaacgtcttcatttttgcccggagccgtcaaaatgacttttttcgcccctgcttcaatatggctcatcgctttttcttttgaattaaatttccccgttgcttctacaacgatgtctattccgcattctttccacggaagctctctcgggtcccggcgattgaacagcataatatgttttccgttgacaatcaggctgtcgtcagcggtctcaacttcttgatcgtatttgccgtgaattgtgtcatactttatcaaatgagcaagcgtttccgggggatagcttgcattaatggctgttatttgaatttgatcatcttccattgcttttctgaacaccattcttccgattcttccaaacccgttgattgctacttttaccttcatgctcaggtcacccctttttaatatgccactctaatttacctttatttatatatagtataacacattaaaagaaatccgccagtacaacttgataaaaatccacccttataccgatcaatatgttgttcaatcggtttttttgcatataaaatgatctttcttccataaaaaaagcaggatcagcgtctcaggctgcctgctttttttcttatatttgtcccggttctttaaatttgtcatttaaaatgctgtcctctaaaacggaagacacctcgccgtaccgtttagcaatatgcatcgcgccccagtcacacagcgcatttaaaattctttccagactgtgcccgtattcactcagctcgtattccactttcggcggcacctgattgtacacgatccggttgatgacgccgtcagcttccagctcccgcaattgctgtgtcagcatcttctgggtgatgtccggcataagccgcttcaattcgcttgtccgttttttcccgcgcatgaggtggcagaggatcacacacttccattttccgccgatcacttcaagcgccgcctctacggatatattgtattttttcttcagcaacggtaattcctcctcatctataggaactaaaaagtgcctatggcacttaaaagtacgttcttttcaatgacacttctatcaatcataatgacatttgccggctgaaaaggaatgtactcttatacttatatcgtttacccggcatcatttcaaccatacattatcgttcaaggaggaaaacagatgtcttcacatcgccaaagctatttaccagcgctgctggcattagccgtcagcgcttttgcgatcggcacaaccgaatttatcagcgtcggactgctgccgcttatatctcaagatctgcatatacctgtgacaacggcgggacttaccgtttccatgtatgctctgggcgtgactttcggcgcgccggttttaacgtctctcacatccggcatgtcgcggaaaacgctgctgctctgggtgatgttgatttttatcgccggaaatacactcgcagcgagcgcttcctcaatcggcgtcttactggcggcacggggcatttcggctttttcccacggcattttcatgtcaatcggggcaacgatcgccgccaatatcgtgccggagcataaaagagcaagcgcgatttctatcatgttcacggggctgacggtggctacggtgaccggcgttccgttcggcacctatctcggccagcaattcggatggaggattgcctttgccgtcattgtggcggtaggaatcatcgcattcctcacaaacgcgcttctcgttccgtcacatttgcgaaaagggacgaaaaccgcattttccgagcaggtcaaactcgtcacaaacggccggttattgcttttatttattattacggcgttaggctacggcggaacgtttgtcgtgtttacgtatttatctccgcttcttcaggaggtaaccggttttcagaaagaaaccgtcgcggccatcctgctcatttacggaattgcgattgccatcggaaacatgattggcggccgtttatcaaaccggaatccgctgaaagccttgttttatatgttcattgtccaggctgctgtgctgtttgtcctgacttttaccgcgccgtttaaaacagccgggctgatcaccattattttcatggggctgttggcgtttatgaatgtgccggggcttcaagtatatgtcgtgatgctgagtgaacgttttgcgccaagcgccgttgatacagcatcagccttaaatatcgcggcatttaatgccggaatcgcgatcggctcgtttgccggcggaatcattacagactcaatcggaatcattcataccgcttggatcggggcgctgatggtgctcagcgcggtcgtattaaccggatggagccggaagcttgaaaagcgggaccgcactgccattgaaaggaggtgagtttttcttcagcgcattttgattttttcaacagaaaataataggaggaatatatacatgacaacacatttacaagcaaaagcaacattgcataacggagtagagatgccttggttcggcatcggagttttcaaagtagaggaaggcgcggaactcgtcaacgcggtgaaaacggcattggtgcacggctatcgcagcgttgataccgccgcgatttacggaaatgaagaaggtgtcggcgaagggatccgccaagggctgcaagaagcgggattaaaacgtgaagacatttttgtcacgtcaaaagtatggaatgccgatttaggatatgaagaaacgttaaaagcgtttgacacaagcttagaaaaactcggtttagattatttagatttatatttgatccattggcctgtcgaaggaaagtacatcgatgcgtggcgggcgctcgaaaccctctaccgggatggacgcattaaggcgatcggggtcagcaatttccaaattcaccatctgaaacatcttatgaaagaaacggaaatcaagccgatgatcaaccaggtggagtaccacccgcgcctgacacagaaagaactgcttgctttctgcactgaacaaggcattcagcttgaagcgtggtcgccattgatgcaagggcagctgcttgatcaccccgtcttacaggagatcgctgagaaatacggcaaatcagccgctcaagtgattttgcgctgggatttgcaaaacggtgtcatcaccattccgaaatcaactaaaaaacaccgtattgaagaaaatgcaaatgtctttgatttcgaactgtcagctgacgatatgaagcggattgatgatctgaacgaaaatctccgtgtcggtccggaccctgacaattttgatttttaaccagaaaaacaccgttcggctttccgaacggtgtttgtttatgcccagccgctcaatacttcctcaagctggtgctttgtatgttcaagactgccgctgttatcaatgacggcgtcagctttttttgctttgtccgctaaaggcatttgcgacgttatccggctcatcgcttcttcttctgtcagggaattccgctccatcagccgtttgagctgaatgtctgccggtacggtgacgacgagcaccttgccgacaagataatcaagccggctttcatacaaaagcggtatatccaaaacgacgaactgctcttttctcgcaatggcttcatcccgctgtttcagcatttccgcacgcactgccggatgaacgatctgattcagcttcagacgcttctgttcgtcagtgaaaacgatagaaccgagtatttttctgtcaatatcgccattttccagcaggatgtcttttccgaatgcttccacaatttgtccgtaagccggcattcctttttccaccgcctgtttcgcgatgacatccgcatcaatgactgttatttttttgtcgatcagcatacgcgctaccgtgcttttgccgcttgcgatgcctcccgttaaaccgatgaccaagctcaaaaagcccactccttcttacattttccaaatcccgatgataatcagcaggactccaggcaaaaatgtcattttatctatccaattccatcttgagagcaaatgccccgcgtttatgccgagtgaaacaaacagcgagctcatcaccccgacagtcacgctcatcataaccggagaaaagccgagaatggccgctcccagcccggcgccaaacgcgtcaatggataaggcgataccgagcagaagcgcctcgactccgttaatggttccggattgatcaatatcggcgctggtcggttttttcaaaatatgaatgacgatgccgagcgatttcacttcaagattaagcagcgttttttcatgcaataagtaatccggctctttagccggtttaaaaaattgccagatgacccatgccccgattccgattaagatcagcccgcccagtttctccgtgacggatacgggaaaaatctttgtcagaaaatggccgatcagcatggatataaacatcacagaggctgaacagcaggcgatcacggcaatcgctttgaacgggattttcatttttctcaaaccgtacgtaaacccgactgaaaaactgtccaagctgacagcaaaagccaaaagcagcaaagaaacaatctccatatccgtttctccctttctcttgatcggcaattgtggcatatgcctattgggtgaatcacaatatatatatggagaaaggtcatcaactgtgttagaaaaaagtcattctgctgccgcctgcttgaacagcttcagtttatgattttttttggcagcgggcgcaaaaatgcgttccccttccgccgaccacgattttagaaatcatcgtgccgcacgttttgcacggttcatcctttttgccgtatacgtaatgtttgagctgaaacattccgatttccccttgagaattgatataagaccggacggtgctcccgcccgcgtcaatcgcttcctgaagggtgtctttaatttctgtatgaagcgtttttatctgcccgtccgacagactgttcgcttttgtctcaggatgaatacgcgcccggaataaagcttcatcgacataaatgttgccgaggccgacgaccgctttttgatcgagcagggcggttttcaccgcgcggttcgtttttgcaagccgctcttttaaataatcggcggtaaatgcttcatcatctggttcgggcccgagctgtgaaagcggcaatgcaatccgttcctctcccggcgcaaataaatgcatcgtgccgaatttccggacatcccggtagcggagctgtgttccgtccgtcatgtgaaacacgacgtgcacatgtttatcgtcaggctcatcggcctgatgaagaccgtatttcccctccatccgcaggtgggacaccatgacataatgatccagatggaaaagcaaaaactttccccttcttccgatggatcggatcgtttctcctgcaatctgccgcgcgaattcctccggctcggcgggttttttgatgatattcggccatctgatatccgccgattcaatcgttttccccttcacaagaccggtcagagtgcgccggaccgtttcaacttctggtaattccggcacaatcatcacttcctttttttctgtttattttgcatcgtaccaggacggccctgaagcataatcagccttcagcggcacgtctaatgccaaagcatgctccatcacttcaggcaccagcttctctaatatttcaatttcttccttaggcgcttcaaaaatcaattcatcgtgcacctgaagcagcagccgcgccttcagttttttctctttcagctcaactgccatgtcaatcatggcttttttaataatatcagcggcgcttccctgaatcggcgtattcatggccgtccgttccgcaaagctccgcaggttgaagttgcggctggtcagctcagggatatagcggcgacgctgcataagtgtcgtcacatatcctttttgtttcgcttcctgcaccgattcttccatatatgccttgacgcccgggaagctctccaaatagcggtcaataaaagcgcccgcttctttccgggtgatgccgagattttgcgaaagcccgtaatcgctgatgccgtaaacgatcccgaaattgacggcctttgcctggcggcgcatcgcttgtgtcacttcatcttcactgacatgaaacacgtccatggcggtttttgtgtgaatgtccatgtcattcgtaaacgcttcgatcagattttcatcttttgaaatatgcgcaagcacccttaattcaatttgtgaataatcggcggcgaaaataagccagtccggttcggacggtacgaaagcctgacggattttccgcccttcctccagccggatcggaatattttgcaggttcggatccgttgagctgaggcgtccggtttgagtcaatgcctgattgaatcgtgtatgcaccttatgagaacccttgcgcgtgactttcagcagcccttcaatataagtcgattggagtttgccgatttgtctgtattgcagaatgtatgcgacgatatcatgtttgtctgcgagcttctcaagcacatcagctgaagtggaatagcccgtttttgttttctttactggcggcaggccgagtttttcaaacagaatgacgccgagctgttttggtgaattgatgttaaacggctcaccggcgatgtcatggattttttcttcatattctttcagttttgccttgagctcttctcccattcgcttcagtctttccacatccactttgacgcccattgattccatttctccgagaattagcgcaagcgggagttcaagatcttcataaagctcaagctgattattttcttccaaagcgtcaagcagtttgtcacggaggctgttaacggcagacgctttccgcgcgagatgatcggcaagctctttttcagcgggaacggcgcgttttgcgccttttccgtataccgcttcatcttttgaaacgatattcagcccgtattctttcgctacgctcgcgacatcgtcgtacgaattgcccgggtttataatgtaggcagcaagaagcgcgtcaaattccgttcccttcagctcaattccctgccagcgcaaagcgacgacggaacgtttgctgtcgaacacccactttttcatcgattcatcttcagcccaagatttaaaagcttcagactgaatggcgatttctttcggaatataataaagacctgtttcattcacgatggaaaagccgaggatcggttcttcgtgatagttatcaccgatttgttcgacgaccaaagcggacggcgaaacgagcatatcttcggtgatttcttctgccatttcgacattgatgtcttcaaaattttcttccgccgtttccccgctttcttcaccgagccgctcaagaagcgtattaaaaccgaggtctttaaaaatggcaacaacttgttcacggtcaaacccttggtaatctaaatcttcgggcttgacttcaatcggcgcatttgtcataatcgtcgccagctctttgctcatcagggcttgttccttatattcttcaagcttttcttttaatttttttccgctgacttcatcaatggaatcaagcagtttctcaaccgaatggaactgctttaagagcttaatcgcggttttttccccgacgccggggacgcccggtatgttatcggatgaatcccccattaatcccttcatatcaatgatctgcaaaggggtcagaccgtacttttcctgcacgtgctccggcgtgtaatcttctacgtcggtaatgccttttctcgtaatggcaacggtcgttttcccggtggcaagctgggttaagtccttgtcccccgaaacgaccttcacttcaaagccgtctttttcagcagatacggcaagcgtgccgataatatcgtccgcttcatattcaggaagctcgtagcggctgatgttgtaggcatcgaggagctcacggatgaacggcatctgttctgaaagctccggcggcgttttttgtcttccgcctttatattctttaaacgtgctgtggcggaaagtggtttttcccgcatcaaaagccaccagcatatgggtcggtttttcatcttccagcattttcattaaaatcatcgcaaacccgtatacggcatttgtatgaatgcctttttcattgcttaaaagcggcaatgcaaaaaacgcccggtacgccagactgtttccgtcgacaagcactaatttttttcgttccgtcattcaatatcctcctaagagcaaaagctcgtcattcctctgttttttaatctcacagcttctcttattttaacaaagttcaatttgaaaggaaaatgagcggaccccgtgaaaacgcaaaaaaggacgggaacaaaaaacgcgttcccgccgtcaaaattggctccttggatgaaggggttctgttacatcctaacaagataggtttaacaggtcatgaagaaattgttaatcctttgtaaagctgatcacgcttccggctgccgcttcagcgtcacagtgaacacagttccctgtcccggctcgcttgtgacctcgattttaccttcatgggcttctattaagtgcttcacgatggcaaggccgagtccggttcctcccgagttgcggcttctgtctttatccacgcggtagaatctctcgaatatccgcgggatctcttccttctgaatgccgattcccgtatcggacactttgatatcgacgacggtttctttcacatgtaccgaaatccccaccgtccctttttcaggcgtgtaggtcagggcattgttcgccagattcaaaaatacctgcttcagcctgtgcgcatcacccgtcacaaaaatcggctcttccgggagatcgagctgaaagctgatgcctttttcctcagccttatgctgcaaaagcgcctcaatttcatgcagaatttttgcagcatcaaaggactctacgcgcatcgtaaagttttgctgctccatcttggataaatccaataaatcctgcacgagagattggagccgctcactttctttcagaatgatagacagaaagtctgaaagcgccttttcgtctttcatcgctccgtctaacagtgtttccgtaaatcctttaatcgaggtgatcggtgttttcagttcatgggagacattggcgacgaagtcctttctcatctgctccaattttttaatttccgtcatatcgtgaaaaacgaggacgatgcccttccattcatcgtcagggcccatgatcggaacgccgtcaacttcaaagtagcgccgctcaatgttgatgggaagtctgagcagctggcattttttcgtctccgtcataaaaatgtcttcgacaagccgaatgatctcctcatgttcaaacgcatcgtggtaaaggcgccgaagcagacgttcaggctttgtatgaaactgcttcgtgtatgaccggttcacgagattgataaaacctctcccgtctattaaaatcaaaccggatccgatattttcaatgacggttaacagacgatcgcgctgcatatcctgcgttcttgtcatttccattaaatcgaccgccaggctgttcatcgcacgcccgagacggtccgaccgccttgcgtaaccgctgtaggagcgggcgtcataattccccttggacagctccgtcgccacctttgtcgcggcgtcgattgattttttgtaacgggacgtcatgtttgtataaaagaaaacgataatgataaaagcggtacaaagacttgctgccagcatgccccacatttctccggtaacgcttgaaccgccgttgatctccgaggaaacgagtacataccccgcaattttccctgcgtcattttttacggcagtgccgcggatgactttgcttttcgactgtacagcttcctcgcttttattgtgagaaatgaactcctttacggctgaatcatcagcacgactgccggaatgatatacggcgtcacccttctcgttgagcacggagacgtttataccgagggtgcggccggcgtcacggattaccgtttcattgcttttattgccgattcggccggtgtcaagaaggcccgctatgtataccgattcctttttcagctgatccgccgttctttcttcagcggatgaagaaataagctgctgtaaaaaaagaccgagaacactgaaaaccaatatgatacatacaacgagtaaagcgaacagacgcacacggactttattcattcatttttggctcctccagtttataccccaaacctctgattgttttaatatagatgggttttttggtatttgattcgattttgtcgcgcagatggctgatatgaacgtcaacaatccgggtatccccggcaaaatcatagttccagaccgcgctcagcagaagatctctcgtcagcactcttcccttgtgttttcccaaatacagaagcagttcaaattctttaggcgtcaattccagctgttctgacttaaaatacgcttcgtaatgctcaggaagaattttcagctcgccgatgaggatctgcccgtccttttcctcttctctgccttgtgacagcgaagaaatgtcagcccttcttaaaatggctttcacccgcgcagtgacttcccgcggactgaacggctttgtcatgtaatcatccgctccgagctccagtcccagcaccttatcaaattcctcatcttttgctgtcagcatcaagatcggaaccatcattttctgctgtctgagctgtttacagacgtcgattccgtccactttcggcagcatgacatccagtacgattaaatccggattttcattctctgccagctccagagcctcttcaccgtctgatgcggttatgacatcatagccggaccgttccagattatactgtaaaagagtaacgatagattgttcatcatctacaactaaaatttttttgttcatgctgcgccctccgctgtctattttccccgacatccaattttctctattttatgtgctgcatatcactttatgatttcattttatccaatactgcccgttcagacaattcgcctttttgatcattttcagagaaaggatcgctcagggaaaaagaaaacgctttcattaattgtaaaaagaggaaggcttctgattcggaagccttcccttttttcttatgacaatactttcatcacgtttttgacagattcaactgatttactcagctgcgctttttcatagtctgtcagttcaagctcgatgatttgctctaggccgtttcctccgataatcgtcggtacgcctaagtaaatgccttcatgaccgtattcgccttctaagtaagcgatggtcggaagcacgcggcgctgatctttcaaaatggcttctaccatttcagtcagtgatgcagcaggcgcgtagtaggcgcttccgtttccgagaaggttgacgatttccccgccgccttttcttgtgcgttctacaatcgcatcaagacggtctttcgggataagcgtttcaagcggaatgccgcccgcataggaataacggacgagaggaaccatgtcgtcaccgtgtccgccaagaacaaaaccggtcacatcttttacagacaggtttaattcttcagcgacgaatgttctgaatcgcgcagtgtcaagcactccggattgtccgatgacgcgttctttcgggaagcctgattctttgtacaccgcatatgtcatcgcatcaacagggtttgtcaatacaacgataatgcagtcaggagaatatttcacgatctcacgtgtgacgcttctcatgattttttcgtttgtagatacgagatcatcacggctcatgcctggttttctcgcaattccggctgtgatgacgacgatatcagaaccggctgtgtcctcgtagttggacgtgcctgtgattttcgcgtcaaatccttgaaccggacttgcttcgagcatgtctagcgcttttccttttgtcgggttttctaattgcggaatatcaacgagcacaacgtccgcaagctctttttgagctgtaagaaaggctgttgtcgctcccgtaaatcctgctccgataacagaaactttactgcgtgtttttcccatgattctcttctccttttttggcttcattagaagtctgctttaggttcagtccatgtttttgatgagctcttcaccgaactctgaacatttcacttcagttgcaccgtccattaatctagcaaaatcgtacgttactacttttgaagcaatcgttttttccatagatttaatgatcaagtcagcagcctcattccagttcaggtgttcaagaagaagcactcctgaaaggatgacggatgacgggttgactttgtcaaggccggcatatttaggagccgttccgtgagtcgcttcgaaaatcgcatgccctgtttcatagttgatgttcgctccaggcgcgatcccgattccgcctacctgagcggcaagcgcatcagagatatagtctccgtttaagttcattgtcgccacgacgtcgaattcgctcggacgggttaagatctgctgaaggaaaatatcagcgatgctgtctttgacgatgattttccctgccgcttccgcttcgctttgcgctttatcagccgcttcttttccgtctttttcgacaatgcggtcatattcagcccaagtgaatactttatctccgtattctctttcggcaagctcgtagccccagtttttaaatgccccttcagtgaacttcatgatgtttcctttgtggacaagcgtgacagacttacggccgttttcgatcgcatactcaatggcagctctgactaagcggcttgtgccttcttcagaaacaggcttgatgccgattcctgacgtttcagggaaacggattttgttaacgcccatttcattttgcaggaagctgatcagcttttcaacttcttcagaacctttcgcatactcaattccggcgtaaatatcttccgtattctcgcggaaaatgaccatatccgtatcttcaggacgtttgaccggagaaggcactccagtgaaatatctgacagggcgcaggcacgtaaacaaatcaagctcctgtctcagcgccacgttcagtgaacggataccgccgccgaccggtgtcgtcagaggacctttgatagcaatgaagtactctctgatgtcttccagcgtttcggcaggaagccactcacctgttttattataagccttttcaccggcataaacttctttccacgtgatttttttctcgcctttatatgctttttcaacagcggcttccaatactttagaagcggcgttccaaatatcagggcctgtgccgtcgccttcaataaacgggataatcggattatttggtacgtttaatactccattagagactgtaattttttcaccttgtgacacaatattacctcccagtatgtaattcatatttagaaaacattttatttttcttgtataaaaaataaaatgacttttctcaagattctatcaaaattgtaaaccaatccgggcttgattaacaagaggctaacgacatgaaaatcaccagcctcccgtttgatcaggctctttcatcaatcggaacaaaagtctgcttatccgggcccgtgtaatcagcgcgcgggcggatgaggcggttgttatcgtactgttcaagaatatgggcgatccatcctgacattctgctgaccgcaaagatcggcgtgaacagatcgtgatcaatgccgagactgtggtatacagatgcggaatagaaatcaacgttaggcggaagttttttctccgacgtcacgatttcttcgacacggattgacatctcgtaccatttgctttcacccgtcagattcgtcaggcgtttgctcatttcttttaagtgtttggcgcgcgggtctccatgcttatacacacggtgtccgaagcccattactttttcctttttctccattttgctgcggatataaggctcggcgttttccacttcgccgatttctgtcagcattttcatgacggcttcattggctccgccgtgaagcggtccttttaaagcgccgatggcggcggtgatgcctgagtaaatatcagataaggtggcgacacatactctcgccgtaaatgttgatgcgttcagctcatgatccgcatgaagaatgagcgctttgttaaacgcttccacttcgatcggagaaggctcttcaccgtttaaggtgtaaaggaagttctccgcgattccgtactcttccttcggttcaacaggatcaagtcctttgcggattcttgagaaagcggcgacaatgcccggcactttcgcctgcagacggatggcttttctgtagttcgcttccggattcatgacatcggcttcactgtcagtcagaccgagtaatgaaatcgccgtccggagcgcagccattggatgtacgttattgaggggataggatttgaagtgctcaatgatttcttgtggaacggcagcttctttcgcaagctgttttttcagttcagcaagttccgttttattcggcaggcgcagatgccacagcaaataaatgatttcttcaaaacttgcattctctgtcaagtcgtcaatatcgtaccctacatatgtaagggtatcgtcgataatagagcttacagatgatgttgttgctacaaccccttcaagaccgcgtgttgctgtcatattcaacctctccttttcaatcaaaattcccctttaaagagtatataaaacatacggcttacttaaaatgagtcatgcaaacaatccctttcccctttaagaaaatgcttacatttcactggttgcggttacataaccggtatgcttatagaggaacataacaaattcttataagcttatttaagtttaagcctattcttattataaacaataatctgattaatttgtagacttttaactaaaaatgttttaaaagccctatatatcaaggcttggcgttgataaatttaatcgcttgctttcagatgctttgtaaaaccatgtattctatgtcttcatttgggggagctttggggaaacattaaaaggacaggcgcgacaacttcaccgcaaatttaatccccttcttaggaaagtgaataatatgaatggggcagagttctcaattttatcggaccgaaaacagcaaatgcagtcaaacgattccagtccatgtacggcctgactgctgacggcatttatgggccaaagacaaagacgaaaatatggtccttgctataatataaagccttcccattaatgtctcttagtggcagccttatagaatttacggacattgttaatatatctttacataaaagttcttacataaaagttcttacataaaaacatcaaatagctcttgagaatcttttaggttctggcggtgttctgttttaacagcagccactgtgatagagcttaacgaaaatataagatcaacaatacaattagtttttcaaattaatcatctcccttcataaaaaaagagagtttatgattacttcagccaagacaagattttcgcttttgcacagcccgtaaatatcctcatcaaaccgttcatcaattgaagctgactcatttactgatgtaagtgaagttaaataaatgcagaaaaaccctcctcatctcgagaagggcttgatttctgcttcttctttctaaatcagtccgaagaaaaaactgatgccgctcaacttttcaatcgaagggctccatcgggttctccaactatttgcccctatgcttttcttttgctttttgttttctgattaaatatttttgttcctttattttttctctttgttttctgttcagttgttttttcttttcttttcttgcttcaagctcctgttttatcgctttttgcgccttagttgatatcccgatatttttcatctctttagaagcttgccgttgtaatctttttgggtttaacttcttagattttgctttaacacaaacccctgcttgttcagtacgggagagagtctgtaaaagttgattatgaacaaaatgcatgatttctgaatccttgggctcttgtccaaacaaatgacgaatggctcttaatttcccatcattcacaacttcaatgactcctacccaaaactgaccatcgtagtaaaccgttaatttcataacgattccctcctcctaaatttactgaagaatgatggacatcccgaggaggggaaggttactgacattttaaatcatgcatccggactaccaaccgaattgtgttttttcattctcactataaatttaacaaactttcaaattgaaggaaagggtctccgcttattttaacaacacttcaagttttgatttggttcaagtgcataaattccatcagcttttaatccattcatcaattggaatcgtcttactgcatccgctgtcatcgcacaatatgcgccgtcgattccgaagttctttgttacatggtaagccacttcattcctcggaataatgcaaatagcatttgtctgaactacaaaatgcgctgcaaactcttattttcacccgcaaaaaaaaagcagctttacgccgctttttttactttatgaagtgaatattttaacgatttgcatggccaagtaggcgattccggcgccgattaacgggccgacggcaacgcctccgaaaagcgcgacggcaagtatcgtgccgatgaccagcgccgttgtaatatgagggtcgttttccaataaggtaagaccgtttttggcgattaaggcaaccgcgatcccggcaccgagagcgatccacgcataatatgatttcatcgcttctccaagctgtttaaaaccgatatcacctgtggcaatcggcactaaaacggcgattgtaatgacggtgaccccccagttgatgccttttgactgaataaccggaaatagtttctgatcaagaccgacagcttttatcacaatgagaaagccgacggcaaaaagcaatgactgatttttggctaccaatgcgatggccagcaataatagtaaaaataaattcgcctgtgtaaacatcctgaaagcaccctctttcatcatatctgtaatcatatccttttttttgacgaataaactaatgtaataggacgtgccgaccgagaggaggatcgatgtgaatccgcactatgcaactgtttttttccgcgcgctgtttgtactcgctgcggccggcggcgctttagcggccggttacgcctcatttccgttaacttatccgtttctgatcgcccttattctgtcatcagcgatcattcccgttgttgactggctggacaaactgacggggctgccacggtcagtcaatacagtcattgtcctggtcttctttttgcttattcttctcggcgcggcaacatttctcgttgcggaaatcatttcgggaaccgcctatctggccaaaacgctccctccccatatcagcgcctttatgacgtattgcgaagagctgttcacttcccgcattcagccattgtaccacgagctgaccgtcctatttaacgggctggaaaccaatcagcaggcctccatcgtgacgcatattcagaccctcggtgatacagccgctaaaaacgcggggctcatgctttcacatcttttggagctggtgccgaaatggattgccttccttcccaatacagctgccgtcttcattttcgcaatgctggcgactttttttatgacaaaggactggcataagctgaaggcgctgctttattccatttttccggaacgggtttcggcaaacgccaaggccgtatcgggagagctgaaaaaagcgatggcaggtttcattaaggcgcaggccgtgctcatacttttcacgatgatcattgtctttatcggactttttcttttagggattgagcatgcggcaaccatcgccttttttatcggcctggttgatctgctcccgtatctcggcgccgggtcggtctttgttccctggattatgtatttggccattgccggtcagcttcctcaagcgatcggtctcggtgttttatatattgtggttctcattcagcgccagctgacggagccgaaaattttaagcaagtcaatcggacttgatccgcttgcgaccttaatcgccctgtttgccggctttaaattgttcggaattttaggactggctgcggggcccgcgctgctcgttttcattcaggcctttatcacaacgggcgctttaaaagaaatatgggcctatattactgttcaatccaaataaaaacagcagccctgtaagaaggctgccgtttttatttgataatgatccgcttgttttttgacatccctctcagccatttgaacaaaagcggcttcatgcggttccgagtgaacggaatcagaagacaggcccctgcaatatcggacagaaaacccggaagcatcaaaagcaggcctccgaaaaagacgcatatcccgtcaagaagcgcttcccccggcattttgccgtgctgcaggtcgcgcatcacccgatgatacacatcggttccctgtctttttgccaccaaagcgcctaacacgcctgtcaaaatgatgagaaggaaggtcggaaaaataccgagccattttcccgccagcagaaacaaaccgatttcaattgccggacatacgataaacagtaagaataacactctcatttttctgccctcctgcccttctaaaagcgcgtcaccgcccgcataggaataggaaaatcagcctaaagacaaaagagaagggagaacccccctctcttttttaaagctgtttaaagaacgcttgcgcggccttcatacacagcgccgcgggcagcgtcaactgtgataacctgtccttctgttaaaactgaagttgcgttctcaaggccgacaataaccggaatgcccaagcttaaaccgacaacggctgcatggcttgtcagaccgccttcttcagtgatgagcgctgatgctttttcaagtgaagcgatcatgtcgcggtcagtgcttgaagcaaccaatactgcgccgtctgtcattttttgttcagcttctttcgcattttttgcaacaacgaccggaccgaatgcagatttgcgtccgatgccttgccctttcgcgataatgctgccgacagtgtggactttcatcagattcgtcgtgcctgattcaccgacagaacctgctgtaatgacaatcagatcaccgcgtttcacgatgccgctgtcaagtgatttttgaaccgcgtcttcaagcatttcatcggtagaattcgcgttttggccgcttgacgggaatacaccgaatacaaggccgagtttgcgtgatacagactcattaaccgtaacggctacaatcggagcctgcggacggtatttcgcgatcatacgcgccgtatggccgctttctgtaggcgtcacgatagctgccgcactcagattgatcgccgtgtgcgcaactgattggccgatcgcatcggtaatcgtcataccgacctgatctctgcgtttagacagaatttctttgtagttcagagattcttccgtacgtgtggcgatgttaaacattgtttgaaccgcctcaacaggatattgtcccgcagccgtctcaccggaaagcatgatcgcatctgtgccgtcgaaaatggcgttggcaacgtcacttgcttcagcacgtgtcggacgagggttgcgctgcatgctgtcaagcatttgtgtcgcagtaataaccggtttgccgagcgcgttgcattttttgatcatttctttttgcacgagcggcacttcttcggccggaatctctacgccgaggtctccgcgcgctaccattaggccgtcagatacttccaggatcgcatccaggttgtccacgccttcctggttctcgatcttaggaatgatttgaatgtcagacgcgttatgctcttcaagcagttcgcggatttccaggacatccgtagaacggcgtacaaatgacgcagcgatgaaatcaacgccttgctcgataccgaatacgatgtctttggcgtctttttcagtaattccgggaaggttgacgctgacgccgggaacgtttacgccttttttatttttcagcgtgccgctgtttaagatttttgttttgatttcgtgtttttccggatttgattccagcacttccaatccgattaaaccgtcatccagcaggatgatagaccctgctgacacgtcgtctgccaggccttcataagaaactgagaatttttcaagcgttcccagcacctgtttcgtagaaacgataatttcatttcccgcctgaagctcaagcgcgccgttttccatatcgtgcgtgcggatttccggacctttcgtatcgaggagaatccccacgtttttgccgagctttttgctggcttctctgatgtttttgattcttgcgccgtgctcttcgaaatcaccgtgtgaaaaattcagacgagcaacgttcatacccgcttccatcaattttgtcagcatttctacactttcactggccggaccgattgtacaaacgatttttgtttttttcaactcgttcacttccttctgaaatcttcagcttcttccgccttaaatagacagttcttttgaaagctgatacatgtttggttcaacagtatgttttgattctaaaatttctataatatcatggtctacaagcttgttgttttgtatacctacgcagcgtccgccttttcctttaagcagaagctcaaccgcgtaagcgccgaggcggcttgcaagaacccggtcagaagcgcttggagatccgccgcgctggatgtgccctaaaacggatacccgtgtttcaaggttcgtttcttcttcaatgcgttttccgaattcaaccccgctgcctaccccttctgcaacgatgatgatactgtgttttttgccgcggtcgtgccctctcttcaaacggccgataatttcctccatatcgtagtccgcttcaggaattaaaattgattccgctccgcctgcaagacctgcccataaagcaatgtcgcccgcatggcgccccatcacttcaataacgtatgtacgctcatgagacgtagcggtgtcacggattttatcaatcgcatcaattacggtgtttaacgccgtatcaaatccgatcgtaaaatcagttcccgggatgtcattatctatcgtacccggtacacctacacacggaaacccgtgttccgttaattttttcgcacccatgtatgaaccgtctccgccgatgacgacaagaccttcaatgccgagtttctttaaattttcgattcctttttcacggccttcaactgttttgaattcaggacatctggccgtatacagctttgttccgccgcggtggatgatgtcaccgaccgaacccagctccagtttttctatttttccgctgattaatcctgaataaccgttataaattccgtacacttcgacgtcgtggtagatagctttccgcacaaccgcgcgcaccgcagcgttcatacccggggaatccccgccgctcgttagtactcctatacgcttcatttcctattcacctcagcaacatatatatgttaaacatatcatgatcattgccctaaaacaatgaaaagggacgcctgagctcccatgaaaccttacctattatacaattaaataaattgtttttaaataaaatttaaggaatatcacaaaaatcacaaaaaataaacgtgagccataggcttcacgtctattcagtttaccccgatatattgatcctcaaccgaaactttcccgattgctttatatttttcatagcgctgtgagatcaattcttcggcgttcaattgaagaagagattttaacgtttctttaagaataccgtcaatgtagcccgcctgctgcttgatatcatggtgagctccgcccttcacttctttaatcatatcatcaataattcctaattctaataaatcgggcgcagtaatcttcatggtttcggccgcttttttcgcaaggctggaatctttccacaaaatggacgcggctccttcaggagaaataacggaatacgtcgagttctcaagcatcagcatgcggttgcccacacctaacgcaagcgcgcctccgctgccgccttccccgatgacgatacaaacgacaggcactgtcaggccggccatctcgaacaggttcttggcgatggcttcactttgtccccgttcctccgccgctttacccgggtacgctcccttcgtgtcgatgaagcagataatcgggcggttgaacttatccgcctgcttcatgagacgaagcgctttgcggtagccctcagggtgaggcatcccgaaattgcggacaaggttttctttcgtgtcttttccgcgctgatgtccgatgacggtgaccggcatgccgtgatatttggcgactccgccgacaatcgcagcatcatctccgtatgttctgtctccgtggcactcaaaaaagtcggtaaacaggtattgaatgtaatcaagcgtcgtcggccggtcgggaaggcgtgcgatctgcactctgtcccacggcttcagatttttataaatctcatcctggagcttgctgagccggtcttcaagccttgcgatttcagcgcttaaatccatctccgaatcttgggtgaattttttcagttcggcgattttcgtctgcagttcaatcaccggtttttcaaattctaatcttgcagccactcatgctcacctcctgtttggtgcatgtccagcagaaatgcgagtttgtctttcatgtcgtttcggtgaatcaccgcatcaagctggccgtgctttaataaaaattccgccgtctggaaatcttccggcagtttttccccgatcgtctgttcaataatacgtcttcctgcaaatccgatcaaggcgcccggttcagcgaaattataatcaccgagagacgcgaaactggccgatacgccgcctgtcgtcgggtgggtcatgacagaaataatcagtccctgctcctcactgaacagttttaatgcagagcttgtctttgccatttgcataagacttaagaccccctcctgcatacgtgcgccgccggaagcggtaaagatgataaacgggactttttcctcttttgctttttcaattgcaagcgtgattttttcgccgacaaccgaacccatgctgcccattcggaatgttgaatccatgatcgcgatcacggcagggaatccgctgatggttccttttccggtaaccaccgcttcattcagagatgttttctcacggtctttttcgattttttctaagtattccgggaaaccgagcgggttttcagatatcattccctggttgaattcttcgaatgaatcttcatccaggaggctttcaatgcgctgctttgcattcatcgggaaatggtgcccgcagttcatgcagacgcgcaggtttttatctaactcttttgtgagcatgatttttttacatttggggcactttgtcataatgccttccggaacatcatgttttgcctgctcagacggcacggaagcatattttttcttttttgtgaatatatcctttaacaaatgattacctcccttttgtgaagggttctcttcactgcatgtcttccgattagatagacttaataataactttaccgaaactattgtactttttttgtcaaacggtgtcatcctccattcgacattttttgctgcaaaacagacggaaacggacggatttcataccgtcaaaagcgttgttcagccttatctgtcagcgttttcaaaagaaataaggattctgctgaaatttttttaagacctgcccttaaaaaaatgccggcagtccgtatattgaacagcagcgcgttgtttttttccaacgcgctgccatttcatttttgtgttattattcgccgatgaccgtgagctgtcttgttttttcagccacttcttcaggatcgaccgtaattctggcgacgcccgtttccatcgctgctttcgcaacagctttcgcaacggcaggagccacgcgtttgtcaaatggagccgggatgacataatcagcgcttaattcttcctctgaaacaagggaagcaatcgcttcaaccgcagcaattttcatttcttcgttgatgtgagtcgcgcgtacgtcaagcgccccgcggaaaattcctgggaatgccagtacgttgttaacctggttcgggaaatcagaacggcctgttccgattacgctagcgccggctgcgcgcgcgtcttcaggcatgatttccggattcgggttggccattgcgaagataatcggatctttcgccatgctctccaccatttcttttgtcagcgcgccttcgactgatacgccgataaagacgtctgcatctttaatgacatcctgcagcgaaccgtcgtttcggtcttggtttgtaaactttgccacttcgtttttcaccgcgttcatgccagccggacgcccttcgtaaatcgctcctttagagtcgcacatcacgatgtcgcgtacgccgaaatggtaaagaagcttaatgatcgcgatgcctgccgctcccgctccgtttgccacaactttaatggatgacatggattttcctgataatttcagcgcgtttacaagtccggcaacggttacgatggcagtgccgtgctgatcatcgtggaaaaccggaatgtttgtttcttttttcaagcgctcttcgataatgaagcagttcggcgccgcaatatcttcaaggttgacaccgccgaatgtcggtgcaagcagcttcacagtgtcaatgattttgtccacatcgtttgtgtcaagcgcgatcgggaatgcatccacgcccgcgaaacttttgaacagcaccgctttcccttccatgaccggaagtgaagcttcaggcccgatattaccgagaccgagaacggctgatccgtctgttacgactgctaccatgttccccttcattgtataatcatatactttatttttatcgtcataaatctctttacaaggctcagctactccgggagagtaggcaaggcttaagtcgtccgcgtttctgacttctacctttgcttttgattccagctttccttgatttactttgtgtaaatgtaacgcttcttctcttaatgacattctaaacactccttttaagtactttgttacatattctgccgcatagactggtacaatcgctggaggtgaaaaatttcagaatctttaaataagatagcacaattgtttcaattgtataacaaaacgattattgttaccactattttaacacgacgttttcgcggcccagcagctcttttaaacggtataacgcctgatggtccgcctgaatatgaaaagtatccggcagcctgatcgtctgcttgtctttttcataatatagataaacgccggtttcccctttatgctccagtaaaatacgcttcatcttttccaaaaactcctgattgtgccggctgccttcgattttgatgtaaacagacggcgctctgtctgcctccgtctgctcaagaagagaggcggatgacatgatgaattgtgtcttctcctgacgctcttccatttttccggcggcgaataaaagcgcgccttcttttaacagcggagacagccttctatattggtcaggaaacacgacggcttccatttctcccgtttcatcgcttaatgtgagaaacgccatatgctgacctgtctttgtccgaatcgttttgatgcccgcgagcaaagcgccgattgacagctgtcccttcggcatctgccgcgctgctgtgatcgcttgcgccccccgtttgttcaggagatccctgaaagcagacaaaggatggcttgagaaataaacaccgagagcttctttttcgaaccgaagcttgtccacgagcggaaattcctcagcctctacatattttggcttaatggagaacgattcttccaaaaacaatcccatttggtcatcgtctgcacgaaaaagttcagcgtgctctaaagccacatcaacggaagccagcaaggcggcgcgattttgattgaattcgtccatggcgccagaaaatataagggcttcgatggttttccgattcacgctttttgcaggtacgcgaaagcagaaatcgaaaagatcctcgaacggtttatgtgttcttgctttataaatatctttcactgccgagacgcctacgtttttaacggcccgcaaactgtatctgacggctccgttttccggcgcaaacggaaaaccgcttttgtttattgacggcggaaggacttgaatcccgctccccttcgcttcatgcagatattgcgatattttgtcctcattgccgatgacgctcgtcaacagcccgcacataaaatataacggataatgcgcctttaaataggcgagctgatagccgatcatgctgtatgcgacagcatggcttctgttgaatccgtagttagcgaattttacaatcagatcgtagacctcgtttgcagtgactacagaatactccttttttaagcacccttcaacaaaatggcttcgctctctgtccagaatgtccttttgctttttgctgacagcccgtctgagcagatccgcttcacctaatgaaaaccctgccatgcgcgaggcgatcatcattatctgttcttgatagacgatgacgccgtaagtgtcactgagaatatttcttacgtcctcgtgcggcacttccacacgcgcgcggccgtgcttccgatcgataaataacggaatattttccatcggtcccggcctgtaaagcgcgttaaccgcgacaatgtcttccagtcttgacggcttcaggcgcttcagcacgtttctcattcctgatgattccagctgaaaaatgcccgtcgtatcaccgtttgacaatagcgagaacgttttttcatcctgataagaaatctcggaaaaatcaattttcgtattcgtctctttttcaatcatcgttttaatggattcaataagcgtcaggttgcgcaaacctaaaaagtccattttcaaaagaccgagatcttccaggtgatccatcgcatactgcgttaaatacacgccgtcatgcccttcttgaagagggacaacttccgaaagcggctctttactgagaacgaccccggccgcgtgtgttgacgtgtgtctcggaagaccttcaattttccttgcgatctgaaacactttatgaagaacggcggattcggacagccgcctgttcagctgagcggactgccgcctcgcctcctcaagcgtcattcccggttttgacggaatcaggcgggcaagctggtcggcttctttcgggctgattccgaacactctcccggtatcccttaacgccgcctttgcggccaatgtcccgaaggtgataatctgggcgacgtgcatggccccgtacttattttgtacatactgaatgacctcatcccttctcgtatcagggaaatcgatatcaatatccggcatgctgatccgctcgggattaagaaatctctcaaacagcagagaatgtttaagcggatccacgtcggtaatgaaaagcgagtaagcgacaagcgagcctgccgcggacccccttcccgggcctgtcacaatgcccttttcatgcgcgtacttcataaagtcccatacgatgagaaaataatcactgaatttcatgcgcctgatgacgtccagctcatattcaagccggcggacagcccgctcatcaggagtgccgaaacggagacgcagcccctcatgacagacttccgccaaatagtcatcggctgatttgccgtccggcgccggaaaagacggaagctgtgtctgtccgaggctgacatcgacccggcattgccgggcgatacgggcggctgcttcaatcgcttccggatgccgcgtgtaaagctctgccatttcttcaggcgtcctcaagtataagtccggcagattcccgctctgatcctcccatttctctccggctttaatagcgcacagacagcggtacgcatcttgatcctctttcttgatatagcggacatcccccgcagcgcagacagcgatttccgtctcggctgacaggcggagaatctcttctgataacgcctcatgtcctttaaacggctggtaccctaaataaaaacggccgtctccgaacagctcccggaatccttcggcagcccggaccgcttcttcaaacttcccggcttgaagcaggctttcaatgtacccgttttcaccgggcgtaatggcgatcagcccctcatgatagctcttcatccattttcgcttcatgccgccctttgccatggattgcagcgcacttgagattttcaccaggttctgataaccggtgtttgtctccgctaaaagaatgagcgggtgtgcttcaagctctgtatcgtccgtgtatatagaagccgtcagaccgataatcggcttaattccgtttgatttgcatgctttataaaactcaatggcgccgtacatcacattttcgtccgtcagcgccaatgatgaatatccgagttccttcgcttgtgtaacaagctcttttacagaagcggcgctgtttaacaggctgtagccgctatgtacttgcaggtgaacaaaagacgacaatgccgccactcctttcccatacgttcattttgcctttctacattataagacgggttttcttaagaaacaaatgttcttttttgactcatcatcatacttgtccgtttcgctcaatatgatagaaaagtgaggtggtgtatatatggatcaggaagccggctttatggcgaatttcatcagcagttattttatcgctctcggtgtgttgctcggcggcgcgctgatcggcggcctcggagcttatttatcaggcgagcctccgctgacggcgatcacaaaattggcgaacaggctgaaaatctgggcgcttgtcgcggccatcgggggaacatttgacgcggtatacagtttcgagcgggggctgtgggaaggcaacacgcgcgacatcttcaaacagcttcttttaattatttcagcaatgggcggcgcgcagaccggctggctgattatttcatggctgacccaggagaatatgtcatcatgagaattcccgagtattataaaaaaccgggatggcagcgtttttttgcgggaatgatgtgcggagccatcgtcagctggctgttctttctgtttacatacggaacgtttcaggaagaacaggtgacgttaattgaaaagcagcgggagcacgcgcgggatttaaaaaaccaaatctccatctatcagaaagatcttcataaattaaatgaggataataagcaaagacttctcatccaaagtgttgatgtgaagctgattaattgggaaaaatacagaatcgcccagcctgacaagatgaaatttgaggaacaggtgaaagataatatttctgaagtcatcacaaaggatattgaaagcgtgtataaaacaaaggagcttttaaaacggacgattgaaaacaaaatatacaccataaatgagaaggaatttaaagctgaagtaaaggaactgacgatttatacgagattgtctgtcgaaattcatatttcttttgcgacgtaattatgtcatttttaaaaattttccatagatctgtcgcttttttctccgcttttttataaactgtagatgagacattttcaacgattctgaagggaggaagggaaaatggaggtttttagtgaacgccgcttggcaaaagatcatgcagcccgaatcagacaaggctattccgcatatgcagaaacagacacactcgcttccctcataaaaaaagaactccaaatctgtaatctccgcgtctacgaagacctgactgaattcggctgctggttcatccccgtgacagatgaacactaagaaagagggtctcccctctacttgtgttcgttacatacctcttccagatcagcaagaatctgatcggtttcatcccagctgaagatggatgcgccggccgcaagcggatgtccgcctccattgtatttccgggcaattccgttgatgaccggaccttttgaacggaaccggactctgatttgatcgtcttcttctacgaaaaacacccaagcgcggatacccgaaatatttccgagtgttccgacaagctgcgacgcttcagaagcggtggttccatatgtctccaaaatgtcttttttaatgaaaacggaagcgacgccgttttcagacagtgacacattttgataaataaagccgttaagcttcaccacatttaactttgtttcatacaattgattgaacagctctgacgatgaaaatgggaactcaatgagctctcccgcgtattttaatgtcttttttgtggtgttcgggaacaagaagcgccccgtatcaccgacgatacccgcgtagatcagctcagctgctttcgtattcagtttccagccgtgctgctttccttccaggtacagctcatagatcatttcgcttacggagcttgcattcgtatcgacccataacagatcgccatacggatcttcatttggatggtggtctattttcatgagctttgcgccggaatggtagcgctgatcgtcgaccctgccttggtttgcggtgtcgcacacgatgacaagagcatctttataggtttcgtcatccacctcatcgagggaatataaaaaagacaaggacggttcaggctgtccgacggcaaaaatatttttttcgggatacgtttcccgcaggatttccgtaaggccgcactgcgaaccgtaggcgtccgggtcaggcctcacatgtctatgtaagataatggtgtcatataatgatatggttctgatcagttcggatttcatcgttttctccttttcgtttttattcatttaatcatactctttatccatggaaaaggaaaatctttcagcaacggtataaacggttttgcaaactcatataatggaggatttcatttatgctggtttttgtttttctcatcgggctttctgcctgcttttacgtgtattacaaagtaaaaggaatccagacgaaacgggcgctggagaaggaatgtttttcggctaaatcaagtatggcattaggcgcgctggtgcttttgtacggagtaaaccaaatgattctgttccactccgttctgaccctggtcatcggcggcgtcttcattttaatcggagcaggcagcgcatgggccgggtataaagcctataagcattatgagcctatccatgcaaaggaagcggagagggaccacgcataatgaatgccaagggacccgggtgcgtcccttaacttctctccatcagctgcaccatgagcatcgcttttgaaacgatgccgctttggcttgacacttccacttccattttcccgaatttccggcccgcctctaaaatgcgcggtttcacttcaatgaccgactccatctgtacgggcttcaggaagaaaatcgtaatgctttcaatgaccagctcgccgcgtttgcgggagcgtaaaaatcggctggcggcctgggttaaaatcgtggtaaacaccccgtaagaaatcgtgccgagctgattggtcatttgcggcgtgacttcatattgataaacggccggcgttttgttatcttcctcttctttaaatccccttgaaacaatatcatccagcttttctccgacctgaggctgcttttgaaccatctgaagcgcttttaagacatcctggcggctgatcattccgatcagtttgtgatgcccgtctgtcaccggaagcacttcaattccttcccaaaccatcatttgagccgctgaggcgacagatgtttttccgatcaccgtgacagggtttttggtcattactttttcaatgggaactgaccggtcatgccccgcgatatctttcggcgtgaggattccgtggattttcatctgctgatcgataaccggaaagcggccgtgtccggtttcatagttcttttcgtaccatttctccagtttatccttagggaacagcgtcactgtccgatctgcgggcgtcaaaatatcttccacgagcacaatctctttttttatgagctgatcatagatcgcccggttgatcatcgcggctaccgtaaaggtatcgtagctcgtggagagaatcggaagctcaagcatatcggccagctcgataatgctgtcgtcggtattaaaccctcctgttaccaaaacggccgcgcccgcttcaagcgcctggcggtgggcgttgattcggttcccgacgattaacaggttccccgcggccgtataacgcatcatcgcgtcaagctccatcgccccgatcacaaacttattcaacgttttatgcagacctgcttttccgccgagcacctggccgtcgatcacattgacgacctcagcgtatgtcagcttttcaatattttcttttttcttctgttcaatccggatggtccccacacgttcaatagtggaaacgaatcctttgttttcggcttccttaatggctctgtaagccgttccttcactgactttcatttctttcgcaattcttctgaccgaaattttttcaccgacaggaagcgaatctatgtatgataggatttgttcatgctttgttgccaagcgtttcacctctaaggacagtcttctcttttattataagggtacgggggattcattcgcaatgagacgcccgaaaaaaggcggcatcacaaaaaagaccttctgaatgcttgattcagaaggtctttgacacatatgtcaggcaagctcaatggtctcgccgaccgccatgactttgccgacgcctccgggcagactttcagcgaaagcgtcagggtcctgttcaatgacggggaatgtattgtaatgaacgggaacgacctgtttcgctctcagccattcagccgcgagtttcgcatcttcaggccccatggtgaagttatcaccgatcggcagaaacgccaggtcaatgtgattcagttccccgatcagtttcatatctgagaacagcgccgtatcgccggcgtggaaaatcgttttgccgtcaatcgttaataaaatcccggccggcatcccggtgtatgtgatggttttgttttcttcatcagtgaccgccgatccgtggaacgcctgtgtcagttttactttgccgaaatcaaattggtgcgcccctccgatatgcatcgggtggacctttaaccctttaaagccgagataaacggccagctcgttcggcgcaatgacgagcgcatcgttttgtttggcgatctgctctgtatctccaacatggtcattgtgtccgtgagtaagcaggatgacatccgctttcacttcttccggtttcaaatttgtcagactgtttccggtcagaaacggatcaaaaataatgttatgggttttcgtttccacttgaatgacagaatgtccgtgataagtcactttcatcgttttcacctcataaaaaattaatatttatcaagttccctttttgacaaacgaaaaaacttacagggattgatgcctgttaatcacattcagcccgcctgttgcttcaatgaccgttccggttacaagatcggaatcttcttcacataaaaaggcgatgattctcgcaatgtcctctccggttccggacctgccgatcggcgtcttttctttgccgattttccgtcttgcttcctctatagacgcttctttcatatctcctacaatatcgcccgggcagaccatattggctgtaatgcctgattcggcttcttcaatcgcaatggttttcgttaacgaagccaatccgactttagccgctccgaaagcggaacggtgaagccagccgggggcatggtccgctccttgaaaaccgtatgtaataatccggccgaagcgctgctgtctcatgaccgggataaccgctttaaacagatggaaaacggcgcttaaattcccttcaagcatgccataccattcgtcatcggagtaatcggcaagctttttgcgctcaaatatgtacggcccggcattgttaatcagtatgtcaatccttccaaaccgctgaagggctgcatcggcgatccgcatgagatcttctttccgggttacatcgcccttaacgaattgcaatctgtcatggcacccgggataatccgccttcagacaagcgaccgcttcttcgtcctgtctgtaattcactgtgacagaaaagcctttttccagaagcatttcagtcacttttcggcccaatccctttgtaccggcagtgattagagcatgtcgcacattgaataccctccccaggcaacgtagccgcttcaataaaatcaagacgtttctccctctactttactataaacaaacggcaatatcacttttttgcacttcgtccgcacgaaaaaaaagccgtctttacagacagcttaattttctgaaggagccgaggcttcctccatgccgacataaccgctttggtatgcctctgagatgagcctggccgtttcttcactttctttttcatcatagatgtaacggtcttgttctttgcgcattccttctacctcccatcttttatagatgtagggtgtctgatatgacgggaaaatatgaaggaaatttcagcaaattaaatgccggcgcaggcttttgcttttacgagcgcctgttctacctgctgaaaacccgttccgccggcgctcattcttttttcaaccgcatgatgcggatcgagcacggtatagatatcttcttcaaagagactgctggcttgaaggaattcttcaaatgccatgtcacttaaatagattcctttttcaatacagctgtacacaagcttgccgaccacttcatgcgcttctctgaacggcatgccttttttagctaaataatcggcaagttccgtcgcgtttgaaaaatcttgttttgtcgcttgtttcatgatgtctttgtttaccttcatcgtttcaatcatgcccgtgaaaatctgaaggcttccttctacggttttcaccgtgtcaaacatgccctctttatcttcctgcaggtctttgttgtaagcgagcgggagccctttcataatcgtgaaaagccccatcatatcaccgtatacgcgtccggttttaccgcggatcagctccgccatgtcggggtttttcttctgcggcatcatgctgcttcccgtcgcgtacgtatcatccagttcaatgaatctgaattcctgcgagcaccatagaatgatttcttctgataaacgtgaaaggtgcatcatcagcatgctgctgccgcttaaaaactcgagaataaaatctctgtcactgactccgtcaagactgttctcataaatggagtcaaaaccaagcagctccgccgaatagttacggtctatcggaaacgtagttccggcaagcgccccgcatccgagcggcgatatgttaatccgcttcatagcatcccgaaaacgctctttatcccgttcaagcatccaaaaataagcaagcagatggtgggcgaaagaaatcggctgggcccgctgcaaatgggtgtaccccggcagaatggtctcgacattggcctccgctttttcgatcagcgctttttggaattgttcaatcagcacgatgatatgcgagacatgatctttcaaatacaaatgcatgtcggtcgccacctggtcattccggcttctgccggtatggagcttgccgcctagcggtccgatttcttcgatcagcattttttcaatattcaaatggatatcttcataatcaacagagaattcaagcgttccttcctctgctttttgcaggagggtctgcagcccctgtcggatggctccttcttcttcttccgtcagaatgccgcattttttcagcattgccgcatgagcgagagaccctgtaatatcctctttgactaagttttggtcgaatgtgatggatgcgccgaactcatcgacccacttttccggtgttttttgaaaacggcctccccaaagcttcttcatgcttcaatctgctccttctttttcacaatgctgtttacttttgtcggcagtccccaaagctcgataaaaccgattgccgcgtgatggtcaaacgcatcgtcttttgtatatgtcgcaagtttttcatcgtagagtgaatattccgacttgcgtccttctacaatggcatggcctttaaacagcttgactcgcacaacgccggtgacgtgcttttgggtttctttcaggaatgcaagcagcgcgtcttttaacggcgagaaccataaaccgttatagatgatttcagacagtttttgttcaattgccggtttgaaatgggccacttctttcactaaagtcagatcctcaagctctttgtgagccgtaatcaaagtcatggcgcccgggcactcataaacttcacgggacttaatgccgaccaggcggttttccacatggtcaatccggccgatgccgtgttttccggcagtctcgttcagcttgagaattaaatcagcgagcgggtaggttacgccgtcgattgaaaccggaacaccggcttcaaatgcgatttcgatgatttccggaacgtccggcgtgttttcaagagatgctgtcaggtcatatgccccttcaggcggcgccgcccacggatcttctaatataccgcattcattggcgcgtccccataggttctggtcgatggaatacgggctgtcaagattgatcggaatcggtatgccgcggcttgcagcgtattcaatttcttcttcacgcgaccattgccactcacggaccggagcaataacctccagatcagggtttaatgatttaatggatacttcgaaacgaacctgatcgttgccttttcccgtgcagccgtgcgctacggccaccgcgttttccttttccgccacttcaacgagttttttcgcgattaacggacgggatagtgcagatacgagcggatacttgccttcatacattgtatgggcctgcatagaaatgagcgcgtactcccgggcaaattcttctttcgcatcaatcacatacgaatttacggcgccaacttccagcgctttttgctgaacgaatgccaaatcctttccttccccaacatctaagcagcatgcaacaacatcgtatccctgttcttgcagccattttatcgctacagaagtatcaagacctcctgagtatgccaatacaacctttttttgttctgccatgttaaaagctccctttgtataaaaattagttttaattaataaaaatgcattttgtatgtatacactgtaacaagtaaattctgttttttcaagccttttataaaaaaaaccccacccaattttttgagcggagcaaagcctttttatacatttataaatcttttcggatttcccggagcacatgaggcagttcaggaataatcagtttactcattgcaagctttacggcgcctgaggagccgggcgtgcagaagactgcggtatttcggatcacacccgctgccgctctggacaaaatggcggcggaaccgatgtcctccgtatagctcagcatgcggaacagctcgccgaatcccgggagttcttttgaaaacagcggcgtgaccgcttcaattgtgacatccctttcggcaatgcccgtccctccgtttaacagcaccgcatctgtatattcatccatacagccggataaaacggctttctgcaattcatctttttcatcttttacaatgtcataagcgaccgtttcaaatcccgcttctctgatgaaatccatcatgacgcgcccgcttttgtcggtttctttcgttctcgtgtcgctgactgtaatcaccttgcagcgcacggctgacggggcttcttgtttatgttcatgcacactcattgcttcacctcatcgtttatgtattaaacatatcgtaacgtttgactctggggcattcaataaaaaagcacaccctaaaggatgtgcttttttcgatcattactgtgcaaggcggacaacgtcgcgtgcgatcatgacctcttcgtcagtcggaatgatgatgactttgacaggagagtgagggtagctgataaacgcttcctcgccgcgcacgttgttcagcgcaggatcccaatatacacccatgaattctaagccgcgaagcacgcgttctctgacttcaacgctgttttcaccgatacccgcagtgaaaataatcgcgtcaacgccgctcattctcgcagcgtaagaaccgatgtatttatggattctgcttgcaaacacttcaagagccgtttccgctctttcgtttccttcttttgaagcttctacgatatcgcgaaggtcgcttgagaaaccggatatgccaagcagtccgctctttttatttaacgtatttaatacttcatctgccgtctgatccgttttttccataatgtacgggatcaatgcagggtcgatgtttcctgaacgtgttcccatcgcaacacccgcaagcggtgtgaagcccattgacgtatcaatggattttccgccttctacggccgcaatacttgcgccgttaccgaggtggcaggaaatcagacgcaaatcttcaagcgggcggccgagaagctcagctgcgcgctgtgtcacgtatttatgagaagtgccgtggaaaccgtatttacggatgccgtatttctcgtagtattcgtacggaaggctgtacaggtaagattgctcaggcatcgtttggtggaacgccgtatcaaacactgcaaccgcaggcacatccggaagcacttctttaaaggctttaatgccgacgatgttagccggattatgaagcggcgcaagttctgaaatctcttcaatctcacggattgtttcatccgtaagcaaaacagaatcgctgaatttttctccgccgtgaaccacacggtggccgattccgtcaatttcatttaaatcctttataataccgaattcagtcagcttgtgaagcagcatcttcaccgcaaccgcatgatccggaatatctgtcacttctgtatttttttcgccgttaacagagatagtgaaaacgctgtcggcgataccgatccgttctactaaaccttttgttagcaccttttctgaaggcatttcgaataactgaaattttaaagatgagcttcctgcgttaattgcaataattttagacataaatgacgctcctatcaaaattcttcttcgtttgttcgttcttttttcccagaccataactgcggtccaaaaaatatctgacttttccatttaaacattgtcaacccagcatttcaagtcaacatccacattggtaccgcttacaacacgaagtcgatattttctgataaatctcatttgtgccaaatggacggcacggccttacggaatgttattttctttccttaatttgtgttttcgccctgatttccattcattttaaaaagcgaaaagcagcgcgggattttgcgtctcacactgctttttcgccattatttttctttttgaatccactgatccaattttgccatcatctcccgcatcgcctgctggttcgcaaaagaaggaagattcgccaaaagcgcttgtttcggcggctttgtgtcttcgccttttttctgcaagattaaaatgctctttgcctgcgcttcgtctttaaacatcgtagccggcagctggagaagggcgttgatatacactttttccgcaaaaaaccgcttcagtttatcgctttgcgcgctgtcaaacagatggttcggaatcataaaaaataagtatccgcccggttttgtatgtttgacgctctgctcaataaataagtggtgagcaaatgagtggccttcatccgctttcagctcaaacgcttcagcgccttcgtcattcggatagtagccgaccggcaaatcgcagataaccgcatcggccggttcgataaataacggctgaagactgtcctggcagaacagctccatttctttttcctgcagattcgcctgagcataagcgatcttcagaaggacatcgtcgatttcaatgccgaagctttttgccgctttgtcagaaagctggtttgccgcggtcagcagaagatttccggtgccgcaggcagggtccagcaatgtcaggccttttcggccgcccgtaaatttattcacgaggtaactgatgaaaaggccgatcgtatcaggcgtcatctgtctgttcggatgggacttatctttcagtccttttaaaatggcgagctggaacgccttgcggatccattcatgctcccattttctgaagtctgctttcgcaagcaggcttttaagctcgccggcttgcttttcctgaagcggaagctggtcggccgtttcaagaaaatacatctctcccgcctccgcaagcccctcaatataagaaatctcaaggccttctgctatcacttgggcggctttatctaaaagttcataaatctgaccgacatggtcgtgttgcatgctgtttcctccttgccatgaaaagagctccgcggcagcacccggagctctttttctttctttacttgattaacgcttttgcagcttcgataggcttttcataattcgggtggtttgtcgcttcgcttacgtattccgcgtaaacgacttttccgtcctgatcaaggacgaatacggaacgtgccaaaagacgaagttctttgatgtaaacaccgaatgcttcaccaaatgacatctctttatgatccgataatgtttccactttatcaattccgttcgctccgcaccagcgcgcttgtgcaaacggaaggtcggcgctgattgtataaacgttcacatcaccgagttttgcggcttcttcgttgaagcggcgtgtctgcgcgtcacatacgcctgtgtcaatggaaggaataacggatatgatcgttactttccctttcatatctgctaatgtcttctcttctaatccgtttgtcaaaaccgtgaagtcaggagcttggtcacccggtttcacttcttgtccgatcagcgtcacggctccgcctttaaatgtaatttcagccattctgattcctccctttatctatgtatagctctatcatagtcgagttttatgcaaactgcaaaggttatgccgcatcgtaaaaaaagctaactgcgggcggcagttaacttttctgttataaatcgatatccgttcttttttggttccggcctttttcattctttttaaacatatgctggatgcgttcaatcgtttgaggcgcggagtctaacagtttatcaatcagatgggtgttttcgtctaaatgaagcatacgcacgccgtttgttccgacaatcagaaacgcaatcggcgtaatggatactccgccgccgcttccgccgccgaacgggagcttctgctcttttctttcatcatcatcggttcttttttcagccggctttcctccaaactcgcttccgcccgccgcaaatccgaatccaacctttgaaaccgttaagattacgctgccgtcaggcgtttcaacaggatcgccgatgattgtattcacgtcaatcatttcttttaaattttccatagcggttttcattaaaccttgaatggggtggtctgccatatgcgctcctccttaaactgatgaatcattctttgaagcaaccggaaccggctgtttctttcgtatgatagaaagtccgttccgcccgtatttgagcaatttgaaagctgcacctataagatgtccaaaacgaaaaaagaatatacactgcaaatgcgtcttggatgcaggcacttgaaaagaaggaatgacttcgtacaccggtttatgtatgaaacgcagatgatcatacagcatcgccgtaaggcctccctttacggcccacaatccgccggcggcgattcccgtaacggcggcgtcttttattccgataaccgtcacccattcgaacttcgtaacacggactcccgcaagaaatgaggcggcgatttggcgcatctgaaagacttggtgcagaatcatttctattctgtgaatgctctgtttgacatcttcatatgtgatttttttcttctcttttttctgacctttcatttctgatttcgtgtcctgtttgacatcaatagacgcgtcttcgctgtttactttaatgacgggcagcgtttttttaaaacggaccagcccgtataaggccgagagtttaaacgtcagtttgtcgttatctttatcgtgaagatattcgaaagtcagatggattttcatcctcatgagcagccagaccaaaatgagaatgagaataacagctgctgcggcatatcccataagcttcacttccttagcagcattatcgccaaaacccaaaaaaataaacccggacgtttattccgggtttactgcttttatttgcggtacagcgcttcgtgaatcaccgttgtgtcggcgatcaaatcgtgaatgccctgctttttgggcgtaaacgcaatgacgatatagagaatccagattttatcgatataacgccccaccgcttctctgaaaatgacggtgctccaagtcagcggctttccgggcgtcaaagaagtgacctttaacccgaagaccattttgccgagtgtctgatgaaaccatttcgtcatgaacacaaaataggcgaggtagacgatcagggttgtgacggaataagctgagattgtaaacattccgcttgttgccgggagcttcatcagcgtgaaaatcggtgaaacgatgagatggttaagtccccagaccaccagccaatcaagaagaaacgcccaaaacctgatccaaaagcctgcatatgcctgctcgggcgccttctgttgttcggcttcctcttctttgccgtgaaagccttcgtaagtcgcgtccattctttcttcccccctactttgcatagagatacatcatccgcggcgaaccggattgcgaaatgagttctttcatattcagaaaatcaatttcgcttttaaacattttcgctgcgctcatggaaaagagcgagcctaatccgaatccttcctcgtatgtgatgactgaagcgtttttcatatttttatggtcctttttcatcgcgctgatcgtatcatcgtaaaaaccgagctcatcaacgaggccgatttttttcgcttgtctgccgtcgtaaacacggccgtcggcaatttttttcacatccgcttttgacatgtgccggccttttgaaatgacattgacaaatccttcataagaatcgttgaccattgtctgcatgatctttctttcttccttcgtcatgtcgcgggtcggggacatgatgtctttatgcgcgccgcttttaatggtttcaaacttgatgccgagttcatcggcgagcttggaataattgacgctttccatgatgacgcccagtgaacccgtgagcgtttccggtgaagcatagattttatcggcggccgttgaaatatagtagcctcccgatgccgccatggagcccatggatacataaatcggtttcttcgtttctttctttagttcttccagttttttatgtatttccgcgctttcgtaaacgcctccgccgggggaattgattttcagtacaattcctttgacgcttttatcttctttcgcacgctcaacctgttttaaaaatgatctgtgatcatacccgcctgagctgagcaggccagcggacccgccgttatcctcaatcgtgccgtccacttcaagcacggcgattttactgccggggctgcccttatccagcgtcacttcctctgtgtcatctgtcagtgatgcaaagtcagacccggtatctccgatattcttcagcaccccgacggtcacacttgcaatgactgatacgccgaaaatgccgagcgcgatgacgagcgcaatccatctttttgcattcatttgttctcctccttttctgtcaatattcgtacgttcccccgtaaaaaaagattcatttttttcatgaagcgctttctcttaacggataaacaggaaacatgttacactattgccacaggtattttaacacaatacctgctgggagaaaaacgtaaatatgacagcaaaggggaatggggatatgaccgatcttcgccgcaatgtttatttttttcacaaacaaaacaacgaaacaaaagaacaagtcagctctttgaagcagcttgctgaatcgcacggttttacagttgcggctcaaccggaggatgccggtattatcgccagcatcggcagcgacggctcatttctgcaagccgtcagaaaaaccggattccgtgatgactgcctgtatgtcggcatcgctaaaaaagggaaagcccatttgtactgtgattttcacagcgatgagcctgaaaaaatggcggccagcatgaccgcggaacagcttgaggtcagaaaatacccgctcattcacgtaacggtggacggcagcaatcattttcactgtttaaacgaggtttccatccgttcaagcattattaaaacgtttgtgatggatgtgttaattgatgatcttcattttgagacgttcagaggagacgggatgatcatttccaccccgacgggcagcaccgcctacaataaatctgtctcaggcgccgttgttgatcctttgatttcctgcatgcaggtatccgaactggcgtcgttgaacaacaacacataccgtacactcggatctccatttattttaagctcagaccggaagctgacactgcaggtggtgcaggacggaaatgagcatccgattatcgggcttgataatgaagcgctcagcacgcggaatgtcaaaaaggttgagattacactatccgataaaaaaatcaaaacggtgaaactgaaagacaactctttctgggaaaaagtaaagcgatcatttttatcataaaaaaagaggacgggcatcactgcctgtcctctttttcatatacgatacggccgccgacgacggttttgaccgcttccaattcatgaagctttttcggatccgtcctgaacggatcaccgctgagtacggtaaagtcggcatcatagccgggggcgatccgtccgcggctatgttctttatggacgatggccgcgcttccctccgtgtaaagctgaatggcttcgtacacggtcaggcactctttttcataataggccggaccttccgggtgctgcttgcttgtacggagcacagccgattgaatgcccagaagcggatcggccggctcaatcggggcgtctgagcctccggcgcacagcagcccttttgacagcagtgttttccaggcgaaagccgttttcatccgctcttctccgagccggtcaatcacccacggaaaatcactggccacaaaatgcggctgaagatcaagtccgatcggcagccgggcggctctttcaatcaatccgtcatctaatacttgcgcatgaatgagcctgtctagctgtccgggctttgccggatatctttcgataacatcgagcaccttttcaaatgcaaggtcgccaatcgcgtgtacggcgatttccattcctttctctctcgctttataaacaagagcggcaagggtctcgtcatcgtgcacctgaacgccggaaactgacggattatcatgataaggctttttcaacagagcggttctgcctccgagcgcgccgtcagcaaaaattttcatcgctccgtattccaggtaaggtccggtcgatttatccagagcgctccagctgtcgacggcttcgtgatgaacgagcagatgggcgcgaaaaggataaaggccgctgccggttaatgactcgtacgcggcaacgggaacggacgcgtctccgtagtaagccagatcttctgaatgcccgcctgtcaggccttttgaccagcagtccgtaatcgccgtttgaagcgcgcgtttgacatagtgaagtgagacgggcggcagggcctgtgtcacaagctcttgggctttatccagcagaagacctgtcggaccggtgccgtcccggacgataatcccgccgtttggatcaggtgtttcggttgtaattcccgcctcgcgcaatgcggccgaattaaccgcaacggcgtgccggcatacccgcttcagcaggacggggcggtcgggaaagagcgggtcaaggtcatgcttcgtgacgtaatccggccgttcaaacagattttcatcccagccttcgccgatcagccattcgccatcttccaattcacgctctgcttcttttgcggcccgcaggatcgcttcttttgacgtcagctgcgacaaatcgaggcgaagctgtttttccccgtgtccgattaaatgcatatgactgtccgaaaaccccgggaacatgacagctccatgtaaatcgatttcctccgtatcaggcgaaccgtatgttccctggagctcccggaagccgcccgtctgtttgatgatgccgtcttcggtataaacggcttcagtgacatgattctcgtcaagcattgtatagatggtgccgccgtgccaaatcgctttcatccccgctcaccctttatcctgtattatgcttttttatcagccttcagccgttcttcacgctgtctcaactccacacgtctgatttttgcggacgccgttttcggcaggctttcgacaaattcaatttctctcggatatttgtaaggcgccgtaatcgtttttacgtggttttgcagttctttgacaagttcgtcactgcgcttttcatcgtcttgtaaaacgacataagcttttacgattgaacctctgatttcatccgggctcgccacgactgcacattctttcacttccggatgcttcacgagcgcgtcctctacttcaaaaggcccgattgtatatccggagctgacgataatgtcatcattgcggctctcaaaccaaaagtagccgtcctcgtcttttttcgcgcggtctcctgtaagaaagtaatctccgcgaatctgctttttcgttctttcgggatctttataatattccttgaataaggccggtgtgctcaaatgcacggcgatatcgccagtttcgcctgtttcgcatatttcgcccttatcgtttataatctctacttgatttccgggggtcggtttgcccatgcttcccggcttaatatccatatccttcaggacgccgactaacagggtgctctccgtttggccgtatccgtctctcactttaatgccgaaatgcttccggaatacgtcaatgacttcccggtttaatggctcacccgcagaaactgcgctgtgaagagcagaaagatcatatttgtccagctcctccacttttgccatcaggcggtattccgtcggggtacagcagaagacatttacttgatggcgctccagcagctctaaatacgtcttggcgttgaatctgccgtgataaatgaatcctgtcgcgccgcttcccagaacggcgagcagcgggctccacacccatttctgccagccgggcgccgcggtggcccacactgtatcgtcttcggaaatatccagccatgcaccggctgatgtttttaaatgggcaaaggcccagccgtgtgtatgtacaacgcctttaggctggccggtcgtgcctgaagtataggacaaaaacgccatgtcctctcttgttgtatcagctgtttgaaaactgtctccgtccgcttcaatcgttaggaggtttttccagccggcatcattttcaccgattgacaatgtcaccagctgctcggtattcacctcgtcaaatgcgtttataaatgaaggataaacgatagcgcctttcacttcggcgtgtttgatccggtattcaaggtctttggcgcgcagcatttccgagcaaggaatgacgaccatccccgcttttaagatcgctaaataaacggcatacgcttcaagcactctcggaaccatgacaatcagcttatcgcctttttcaaatccgagacctttcaggcgggctccgattttattcgtttcttccatcaatttttcatacgtccagactttcttgccgcctgtttgatcttcccaaataagcgcgttcttctctttggaacggctgaacttttcgatttcatttacaaggttatagttctttggggcgattaaatcttctcgttttaacacgaacaactcctcactttctttccccattatacataaacataggccattacaataaaaatatgcataaattgcttcccgcttctatctatactcatgaaaaaagagcgggggaattccccgctctcttagccattatgtgaagttgtgattaaaactgctgctggctgcttccgcccatgctttgctgagcaaaagagacaagacgttttgtgatttctccaccgacagaaccgttggcgcgagaagttgtttccggtccaaggtttacaccgaattcagaagcgatttcgtacttcatttggtcgatagcttgagcagcgcctggcactaaaagctggttgctgtttccgctgtttgattgtgacatgtgtatcacctccttgtgagtatagaatgtgataaaacacatgtcttcattcaaaaaaactttggtaattgtatacagttttaaaacaggccggcaaacttatcgtgagcttcctgctctgagtaaacagtgatggtttcgatgccggcagcggcctctgcaatcagcggttcaaaatcaacgaagctttcgaagtgctcgattttttcttttttcggacgtgttttcggacttggcggcgtaaagatggtgcagcagtcctcaaacggctgaatgcttgtttcataagtgccgatttcttttgatttctcgatgatttctgttttgtccattccgattaaagggcgcaaaaccggtgttgccgtcacggcattgatcgcatacatgctttcaagcgtctggctcgctacctgcccgaggctttcccccgtaatgatcgcgagcgcttttcgttcttctctgattctgtccgcgatttgcagcataagacgccgcgtcgccgtcatcgtatagttttccgggatttgtttttgaatgagttcctgcgtctttgtaaacggcacgatatgaagcgtcatactgccgccgaacttcgcgaggcatcccgcgagatccatgactttctgctttgcccgttcgctcgtatacggcggactgaagaaatgtacggcttcaactgataatccccgtttcatcgcgtaaaaaccggcgaccggactgtcaaaaccgccggaaagcatcagcatcgctttacccgcggaaccgacaggaaggcctccggcgcctttttcgttacgaatggtcaggaatgtcgcttcctccctgatttcaatccgaagcggaatatcgggatttttcacatcgacggttaatccatccgtgtttttcaaaatatggccgccgatttcagcgttcatcgcattcgtatctaattcaaactgcttgtaagcccgtttggtctcgaccttaaacgtattccccggtttatattcgccttctatcgcggctaaagccgtttttttaatgtcttccagcttgctttcgcatttaattgcgagactgaaactttgaatgccgaatatattctttaataaggaacaaatttcctccgggttttctccattaagtgtaattgacatccggtcccggtttgaaaagtattttacttttttataatcctttaataccaggcggatattctgttttaatctttcaataaaactgcgtctgttttttccttttgtggatatttcaccaaaacggattaaaatatgatcgtaattcatatgctacctcatcattttttttagtttttgaacagccggcgccagcgcggccataaacggctccgtgatgtcagccgtatggctgaagttcaggctgactctgatgctgcttgatgcaatctgttcgcctttattcatttgcagaagaacacggctcggtttgtgctctcttgccgaacatgccgcggttgtggagacatatattcctttttcctcaagcatgtgcagcagcacttccgccttcacacccggaacggaaaaattaatgatatgcggcgcgctattttcggcgggagtgttgatgacgaccccgtccgtcccgctcagcctttccatgagcgcattcttggcagcctccacggaagaaagccgctcattcatgtcacgcgcggaaagattgatcgctttcgcaagggaaacggcgcctgccgtgtgttctgttccggcgcggacgcctttttgctgcgagccgcccgttataagcggaatgagccgcgttccttttttgacgataagcgctccggtcccttttaagccatgaaacttatgccctgaaacggtgcaaaggtcaatgcccgcttcttctatagacagaggaactttatgaatgccctgcacatgatcaacatgaaacagaatattccggtgctgcttcaaaaacccgccgatttcctttacgggctgaatggagccgacttcgttattgacatgcatgacgctgacgattatcgtatccggcctgatagccgatttgacgtctttcaaagaaacgaagccgttttgatcggccggaagatatgtgacttcaaagccgaacagctctgtcagctgatcaagcgtctccgtcacagaaggatgctcaatcgccgaagcaatgatatgtcttcctttactcatgtttgcccaggccgctccctttaacgcagcgttattcgcttcagtcgcgcctgatgtaaatacaatatcataattttttaaacgtaaggttctttttatttgctgagcggccgcttcaaggagctgttccgtctcagttcctaactggtgcagagacgaaggattgccgaaataacggctgctcgtctgtttatacacttccaaaacctcttcatacggctcggtcgttgaactgttgtctaaatatatcattttttttactccttttatgaaaacggtacatcgtatgatatttatgctaccataacaaaagtaaatagaaatttgcaataaatcgagtattgacttctctgtacattgccatataataagtaatgttcgttttgttatattatctgacaattaattgacagaatatttcaacatagtatttaggaggacttttatgaaacactcactacctgtcaaagataccgttattatcggtttcatgctcttcgcactttttttcggggcaggaaatatgatatatccgccggagcttgggcaagcggcggggcataatgtctggaaagcgatgggcggtttcttactgaccggcgtaggactgccgcttttgggtattatcgccatcgcattaacaggcaaagacgcgaaaggacttgccgataaagctcacccggtattcggcactattttcaccgttgtgctttatttatcaatcgggccgcttttcgcgattccgagaaccggaaccgtttcatatgaaatcggtgcagttccgtttttaagcggcatcccggaaagattatctttatttgttttcacgttgatctttttttctattacgtattatttagctcttaacccgtccaaaatcgtggacagagtcggaaagattttgactcccattaaattcggtatcattttaatcattgtcgtaaaagccatagtcactccgatgggcgggctgggcgccgtacatcaggcatattccggaacgccggtgttcaaaggatttttggaaggctataaaacaatggatgcgctcgcctcaatcgtcttcggcgtcgttgtcgtcaacgctgttaaaagcaggggcgtcacccagcgtaaagcgctcgcggccgcttgtattaaagcgggtctgattgcagcggcgggtttgacattcatttatttatctttggcctatctgggagcgacaagcacggacgctgtcgggccgctcggcgaaggcgcaaagattttatcagcttcatctgattacctgttcggttcactgggaaacatcgttctcggcgccgccatcaccgttgcgtgtttaacgacaagcatcgggcttgtcacatcttgcggcgaatatttttcaaaattgattcccgctttatcatacaaaatggtggttacgattgtcacgctgttcagtctggcgatttcaaatttcggacttgctgagattattgcattttcagttcctattttatcagccatttatccgctggcgattgtcattatcgtcctttcctttattgataaaatctttaaggaaagacgcgaagtctatatcgcctgcctgatcggaacgggactgttcagtatcctggacggtttgaaggcagcaggcattccgctcggatcattagattcattcttaaacgcaaatcttccgctttacagcatgggaatcggctgggtgcttccgggcattgccggagcgatcatcggctgcatcatcacgttttttatcagcccgcccatcgaattaaataaagcaaaatcgtaacattcagcgcctgcggtttgatgtatatcagccataggcgctttttatattccgtgagaaacaaaaaaactgcacctctgatttccatcagggtgcagtttttgcttgtgcgtctatgaagcagattgatcagctttaatttttttcacggcgccgggagctgctttttcaacagcagctgctgccatctcataagcttcattatagctgtaagcgtaaaacagccgttccgcttctttcagctgttcggataaaatatgattctggcttcggaagcggttgccgtactggatgatccgctcaatcagcttcacctgaatcacaagttcttccgcctcttcgctgacttccgcaaccaccttttcagcttcggtcagatgtttggcggcttcctccatgtttaacggcagctcttccaattggctgacggtctcttctatatgatgatttgccgtctcgagcttgtccttgacttcttcaggaattcccggcacgttgcttttttgcagcattcgggccgtgtcagaaatggttttccgaagatgcatcagcgtttcccgcgcctgcagttcttcttttctgagcgcctgcagattttcacggtattcggcatgttctttctgagcctcttccatctgcttttcgatggcctcgacttcttcaatcagcagagagtaagcgacatgctcgccgtcaagcttttctctcgcctgctcaaggagccggccgatcgtttccagctgtttttcgaaagcatgctgtctaccgatttctcccgccgtcagctgatagctttccttgacgagctccgtttcggtttttgtgcggtctttttcttcctcaagcttctcatacgcgatgatcagctcaggcattttgcttaatacggactgtccggcttccacttcgccttccagctgttcatacatcgattgaatggtttcatcaatcagctgaagaatggcggacgcttcgtcgacatctaattcttccaaaagcgcgctttcggcccgtttcaattgatttgtgagtgtctccagctctttttcgatttgaatatgctccaatttgtagcctttttccgtcatttcccggtagccgtctttcagcttggcaatttggttcggcacggtctgtttacagtccgcgagcagtttcggaacgtcatctatgtatgtttgaagctgatccagtctgcggtcctgttcaagcagcacttttctcgctttgatgtaattgccgctttccgtctcttcttcgaacttttttatgccgctccagatttcgtcgagatccgtctccaggctgttatatagctctccgtagagatggctgtacgccagaaggttttttcgcgcttttgaataccgctcacgcacctgttcaatctctccgcggcttttttcctcgctcgtcacaaggtcgctgatctcacgcagtatgccttctatatttgattcggctgcagtgaggaggtcgtcgatgtggacaagcacctgattcgcttttttgaaccggtatttgtcggcgttctcttcggcatcataaaggagctcttctactttcggcagatgggctgtgacaatttcatcccactcttcgcgccatctttcaaagaactcttccgtctctccggtcattttcagatgtttgatcttggacatttcttccactatcgaacggtttaaaatttcaatcttccatgactccagccggtcaatttccgtataaatttttttcctgaaaaagtagcccgccgcaaagagcgcgagcagtataaccaataatccgatgactaactccataatgagcccccttgttgttctcttaatctgtcagggtgttttatgtattcagaaagatttcaatatatgtattgagaaaatctgtcgttttcattgttattatgataccatgtaaccaacattttttgaccagaaatcaaaaactttttgcataatttcggcaggattctgcaattttttaatggagtgacacaaatggaaaaacgagacgctcatatccacacgcctttttgccctcacggctcgaaggatgcgctgaaagaatatgtcgaaaaggccctggaaagaggctttgactcgatcacatttacagagcacgccccccttcctccgtcatttcaagaccccgtaccgtttcaggacagcgcgatggatctcagacagatggaggtttatttggagcggctgtcacagctgaaaaaggaatacgatggacaaatcagcattctgaccgggctagaaaccgattttatcacagggtatgaagaggaaaccgcggcgtttctgaacacgtacggcccctcactggatgacggcattttatccgttcattttttgaagaccggtccgtcttatatctgcctcgattttgacgagcatgcgtttcggcagcttgccgaccacttcggaagcgttgaagccgtatatgaacaatactatgaaactgtgtattcttccattgtaacacctctcggcccctttaagccaaaacgggtcggccatatcacgctcgtcaaaaaattcgcacgccttttcccttacagcatgtcacctcaaataagagagcttgcggcccgctgtcttgacgccgtgaaagaacacggaatggagctggatgtgaatacatccgggctcagaaagaagtttgccggggaagtatacatggaggattggatggctgagacggcgaagcaaaaaaaaatcccgctcatattcgggtcggacgcccatcaagcggaagatgtcggcagttcctatgaaacgtacaaaagcatcattacttcataagcgccgcatcaggccgtcggaacacgctttcgatccatatcttcacctcttcaaaataccttttataaaagtacggttcatgaggctgcatatagagcacctccgtaatgtattgaggctgaagatacggcatcatcaagagggatttcaattgcagaataaaatgcggcacgggcagcgtcagccgtctgtagcgtgactgcccttcttcaattaccagctggaaaatatatttttctttcattaagtaagtagacataatttccctgataagcacggaatcaatcgtcacttcccggtacacaaaccgcgttaattgacggttatcgtgctgataggataaaatatcgaaaatcacccgcaggatgcgttcctgcgcgtcttcaccgttcatactgacggcggctttttccagcgcttcagtatagccttcgtaaaactcggaaactaaatgttccattaatccgcctttccctttaaaatagtaggagatgtgcgcaacatttacatcagctgactttgcgatttcacggacggacgtgccggaataacctttttggttaaacagctggacagcggcgttaataattttgtctttggtgcttactttcatacggctcacccctttatgtgtaacaattcaagcagaaaggcgccgttcctgtaagaacttctcgacaaatgccggcagaacggccggaactttgtttgatattatagaaaaagtgagggttttccatgtttcatgtcgaaaaacaatccggagataaagaaaaaagttatcagcttctgcttaaacagctcgaagccatgacagaagatgaaacggatgcgatcgcaaattacgcgaatgcatcagcgcttttataccattcattacatgaagtcaactgggcggggttttacttcgctaaagagggcgagcttgtgctcggaccgtttcaaggacttcctgcctgtgtgcgcattccgttcggcagaggcgtatgcggcactgcctactctaacggcgacgtgcagcggattgccgatgtgaatgcgttcccgggacatatcgcctgtgacgcggcttcccagtcagaaatcgttctcccgatccgcgtaaacggtgaagtgatcggtgtgctggacattgacagccccgtgaaaaaccgttttgatgaaacggacgaaacctatttagcaaagtttgttgaaacgcttgaaaaacgattaggataaaaaaaggagcccggccggcaggccggctccttttttatgtcgtcgtgctgttttgatggatgatcagccggtttttgccgttccgtttggcgatataaagcgcctcgtccgcttgctgaacgagcattttcaacggcatcgggcctgtctttgaccagcaggaaacgccgcaggaaatcgtcacgcgcggctcggtgttttcccggatggcgcgaacaagccttttagcgatgcgttctccggatgacacgttgatattcggcagatagacagccagctcctcgcccccccacctcgcagcgacatcatgctcacgaatatggtttttcataacggaggccacctgaatcaggatcgaatctcccgtttgatgaccgtatgtatcattaatggttttgaaattatcgatatcaacgaggatgaatacaccccgtttatgaattttcatgctgtattgaattttctcatccaaataggttcttgaatacagctccgtcagctggtctgtctgaacaagatgctcaagcctgtcgcgcagcatggagttcgtgaccgctaatgtcgcatggtgaatgagcgcttgaaaaagcttatacatttcaaacgtaaaagcatataaatcctttttcaataaaatcgcgaacccgaagacggtgtcattttcgatcatcggcaccgccatcagcgagccgaagccgttttcgccgaatacagtctttccgctgccgataaacacgcccttttctccctcgaacagcttttctttcacaatgctgatataggggttcgcacgttctgtcttaaaaaaagcggtatgtcccggaagcagattttgcgtctcaaaatgatcaatatgaaaaaaagccacttcttccgcatgaaatgattgggtcataatggcggcgagttcccgcatcgtgtcagtgagtctgaggcgctgattcagctggcgcgatgtttcattaatgagctccagattcgcaatgctttttttcgattgctcatagagctgcgcattttcaaatgcttttcccgctgcgcccgcaagcagcagcatttcactgagagtactgcacgaaagaacggcatcctgcagcccctccgtcttcagaaccccgtaagtcccctgctggcctttgatcggcaggtaagcagatgacctgccttttctgagcagtctccccgataaataaaccttcagggcagacgggtcggcatcttttccgtccatatgtaattcttttgcgggaagctgtctgtccgtatcctgatcctgcgtgataaacagtgaaaagcggaaagaccggaaagccgtactcaaacttgcctgcagtttttccaaaacctcattttgatccaaaagcgaatggaacatttctgtcattctgtgaattttccgctgatgcttcgttttgtcaaacagtccgctttgtctcacagattgattgataaactgagtaacgatctcaggcaatgattccgggatcggcagcccgccttccgagcgcagataaaaggatctgccggacgtctgattcctgatcataaaacggccgtcactctctttcagcggagcataatgcggttcatcttctgtttttatggtgaaacgtgttgattctgccggtgaaagggtcaatgaaagagatgtaaagcaggattctagagctgaggccagccataacagcgagtcggataatgagacggattcagatttcgttaagaaaaaagaaagcattttctgatgaaaggccgtcacttcatcaattgtttgttttttcatttttatcacctaaacatgtactactcatttttgtacattatatcataaaccggcactcttcatggagaaatggttgacggcggcggggaaaaatcatataatgttctttgtgtgaaatattgcagcctttttgttcagcttctgtgtttgcattttgttccttagctgtaaggtgtatcgtgtaactctctgctgctggagcgaggatacatgaaaacaaaatgtgcacggtcggatcgaacagacggtttttattttccacaaaataaaaccaaaggaggagtcacattatggctcgctatacaggtccatcttggaaactgtcccgccgtttaggaatctctcttagcggtacaggtaaagaattagaaaaacgcccttacgcaccaggtccccacggtccgggacagcgtaaaaaactatcagaatacggtttgcaattgcaagaaaagcaaaaacttcgtcacatgtacggtgtaaacgaacgtcaattccgcacattgtttgacaaagctgcaaaaatgactggtaaacacggcgaaaacttcatgattcttttagatgcacgtcttgataacgttgtgtacaagctcggtcttgcacgcactcgccgtcaagctcgccaattagttaaccacggtcacatccttgttgacggaagccgcgttgacattccgtcttaccaagtaaaacctggtcaaacaatcggtgttcgcgaaaaatcaagaaacctttctatcatcaaagaatctgtagaagtaaacaacttcgttcctgagtaccttactttcgacgctgaaaagcttgaaggtacattcactcgtcttccagagcgctctgagcttgctccggaaattaacgaagcgcttatcgttgagttctactcccgttaagtaaaacgctctttaaagagcattggattaaaccccggacatgttgtcaatgacaatgtttccggggtttttcttttgggctgctccctctctttattaaaaaaagcccctgtccggggctttttttatgtgccaactggcttttcagctacatgtacattagaaaaccccataatgcctgcaacagataatgccgcaaaaagaattctctttttcatcaaattcctgccgcaaacgcagaaatgagtttgttattttttctgacacaccataagcatttgacaggcaggagcgattttttacataatgaatcatcataccttataaaaaggagagacggaatgaacagcatcccctctatcgtcagcaagcacaaagcctattttgcggcggggcatacgagaccgctagaatcaaggctgaacatattgcaaaagctgaaacaagccatcaaaacacaagaagccgatatagcagccgctctctatcaggatctccacaaatccgaacaggaggcgtacacgacagaaatcggaattgtactggaggaaatcagttttgtgatgaagcggctgagaaaatgggtcaaaccgaaacgagtcaaaacgcctctgactcacctgggctcgaaaagcatgattatccctgagccatatggaaccgttttggtgattgcgccttggaattatcccttgcagctggcgctttcacccttgattggagccattgcggccggaaacacagtcgttctcaaaccgtcagaatatacgcctgcggtttccgctgttctttctaaacttatcagcagcgtttttccgagtgattatgtcgctatggcggagggcgggcccgacgtcagcactgtgttattacagcagccctttgactatattttcttcacaggaagcgttgccgtgggaaaaatcgttatggaggccgcctccaaacaattaattcccgttaccttggagctcggcggcaaaagtccctgcattgtccataaggatgctgatatacagcttgccgccaaacgcatcgtcttcgggaaatttacaaatgcagggcaaacctgtatcgcaccggattatttatttgtccaccaagatatcaaaacgaagctcatagaagaaatgaagcatgcgatcagtgaattttacggcccccagcctgaacaaaatccgcagtactgcaaaatcgtcagtgaacgccactatcagcggctgctcagctttctgaatgatggcgtcccgcttacaggcggacaatttaatcctgatcaccacaaaatagcgccgacgattctagatcaagtgaaggatgactctccagtgatgcaggaggagattttcgggccgattcttccgctgtttacatacggcgatatcgatgaagtcatcgaaaaagtccaatcacgcccaaaaccgctcgctctttatgtcttcacaacaaacaaaggaatcgagcgaactgttttagagaatctgtcatttggcggcggctgtgtcaatgatacgttaatgcacgtcgcgacaccgtatttgccattcggcggcgtcggagaaagcggcatcggcagctatcacggatttgacagctttaacgcatttacgcacaaaaaaagcgtcgtcaaacaaacgaaccgcttcgacttcgctttccgttatccttcttccaaaaacgggctgcgaatgattcggaaaatacttaaataaaaagcgcagagtatctgcgctttttataaatcctctatacaccaattaatcggtttgcctcccaaattaaacctatttttaaaagttcaagtcgaagtctaatagtaaaaatgaaccaacccaactgtaggaaaggttaatcctcatcaccctggtgagtcctataataattttcagcagtgtaaatattccattcccaaaaacttgatccctgagataaaatatacctatctaagaatatctcaaaattaagttgcatgggttcatactcaataaatccgcggaaccataaatagtttggatctgcggacattttggttttgttaattaacaaataacatccgtctaacagatgtgcgacgggaataaactgaggctctaaaaaaccattttgcatatacttttcaatatcttctaaattaagaatatgcaaacccccacctacattctcaccgtaaatcaacaaatcaaatattctggctccgttatgcaattttaaaaaggttttataatcttcaggaagtgagacttttattttcttctcaaaactctcaatctccagatctgttgcacctttaaagaaagtacattctgtttctaaaagagctccttcattccctaaaatgtttaagcggccttcttcatcaattaattcttttagaccttgaagcgttttttcaacaaaaactgccattgagccacctcttactattagagcattgctattttattcacaagagcaggagccaatgttccagttgaagtatcaggaagtgaacctttccatccggctaccgaagtatgttggaacataaaaaactttgtctttttaggataatacgactttgaatatgatttacctgctttaatatccttccttaaaaattctctattatggagaaaaacccttccatattttttccgctataagtgttacttacgtataatcgtttgttcctcctccccaccacttctttccgggtgcctcctgttgtggcactttaaacagatcgttttatgattatcaagattaaatgccacgcttggatcatctcttaatgtgttggtatttgcctccgttattaatccacgacaacgtcactcacaacacaaatagccgtcccttatcagaacgactttccttactcgcttccagcgtgctgtattatatattttgtctaattcgtcacgttgccttcccatgcttattccttttctgatttacctgaacagactacacacgacaagcagaagaacgtgagcgcaataaaccatgacatctcaaatgagtgcgcataaattgtttccatgctctatctcctttactcaacataataaaagcttctgtggatagcggcttgggtgttggcatcctttcagccgcacaccttagattatttcctaattcctcaaaggcttgactaattgttttcatgtaatccctccaatcatattctttctaaactacccccgcactcagcgttaaccgccaattgttctccctgagatttaccggaagcagtttacagagaatataaaaaagcaccatcccgtagaatgatgccaactgtccaatgcctatcctttagattcttttttagattcttttttaaactcttccattacttcgtctaataacaacttaaaaccccgctgctgttcataatatctcttacttttagttgtgagccacccccacgtcccaaacattataagagtcataataatactaaaataaaatattggcgaaactagttgcattccaatttcaataatagtattaaggatgtctccaggatttatcttattttctttatccttttgtaacatagtgttggaaaaactattagtagtattgaaatagaaagtgaacataacaacaaagacactaagcactgcggcaagagctgatgtaagtaatgtaaaaggaatagttgtaagagagcttagatcacttgaaacattgagattcgaatctaatctattaaccatcagtttcaattgctcttcactgtgatctctttttaatgcttctttaacaacttgctgaatggtcagattttctttatagggtttcccgtatcttttttctaggtatttcgatatttctttcgcttccatcaacgaatggttttgcatattatcacctcaatcccttttatcggcaaaagagcatgacaatgaaaccatccgcaaaatttgtcgaacgatttaccggaagctgtttacagagaatataaaaaagcaccttaaagggtgctaaacttgaattaataaagtatagattttggaatctcaaattcaccttctaacaaatcttcggtatccaagacaataacttgatcccgaatcccttcaaaattaattataatgctatcctcaattcgtttatctggaagcactatcctaatttctctttgagttttaaaaaaaaggtccttccaaaaaaacatatcaatagaaccattctcaaaaagtttccttctattttcatctagaaaattaaaatcgcaatattgcactagtttcgctacgcctagaatattttgttttttcaaagacgagagtactttttttaagaaatcacccggaaaaattatcgctttctcaccaaaatctttaataaatacatccttttcttctggattcaaatctagtccaataattatcttctcatctttttcttctaaaattttaaaatcttcactaggaaaataggtaaaacaatataatggaatctttgatgcctcagtgtacctttcaataatttctgcttctttactcactcctatgactttttttgttctaaggtctatgattcttaaatcgactgctcttgttacaaaagcagcttcgaacttgtctccctgtcctttaattttctctttcttttctaaatctatgaagtgtttaaaattcttcatgtatagctttccatctaaaatatcatttacatactcctcttttgtaaatttcacaaacagattcaatttctcaaactcattttttaatgtacccactttatcgtcctcccaccttattatcgggaaaagggcgtgacaatggaacaatttgcgaattttgtcgaacaatttaccaaatcagtttacagaggaatataaaaagcaccccgtaggatgctctgattatttcttaaatagttgttgatatttaagcatatattgccgtataacttctcaaatacttcttgccatctaccggcatcaaaaagctctttggctaaaaattcaacaaagtgataattgccattttgttcaggaacaattttatacaaagcttgttcaaaggaaccgtggtgtacgtccattttattctcaatacgggttcggtagtcatcaaaaagatcataaatttgatctacttgttcttctgttattttatattcgaaaaacaaacgtgaaacagaatcgtcccgaaataacaattcctgtctgtattaaataaacttcaatcttttctctaaatcactcattctatcacctcctacctttattttcggcaaaagagcgtgacaaaggaaccattcgtaaaatttgtcgaacgatttccgaatgcaatttacagaggatataaaaaagcgtcctgctgggcgatctaactataatttatttatttttctttttccattcaaatttacgtttgatctttcgaaaaaacttgtgcttctcatcttttttttctaatcctaaacttatagctttctctttataaattttggcgattttcttatctgataattcttcccccttttttatttcgatttttattcgcttccactcagctttcaaaatcacttgttgaattaaatttaattctttaatgtgattgtcatatgctttgacattataattgtaatcaccggttaaaagaccaataatttttactaattttttagataatctatcagaaaactcttcattgggatttaacaaaagattaatacgatcgcataaagctcttaattcataatgtttttctgtaaaatcaaaatcatttttctctttatttttttcaatagtatttttattggaagagtatgcataagctaacttattaaaatccacgaactggtctcttaaattattcatccacagtattctttctgtacttattgtgctttttagtgctgcctttttagcaactctcccgctaatccacgcaccaattaaggcagccaatattgtagctattggtatccaaattgaactagaaatacttgaagttgtactcgttactttttctgccactcctaaataaccactattaaacaaagtttccactctccttaattatattatcaataaatgagagcgacaatggaacctcctgcgaaatttgtcgaacaaaagttcctttcacatattagtcccaaccgtaagacaaaaaatgatattttttaaaaataggcacagacacgtataaataatacgtgttataatatatatgaagggagggaaacatgaagtcttcaagagatatcataaagatacttacaaaagatgggtggtatttaaagcgggttgttggtagtcatcaccactttaacatccaaccaaaccgggcacggtaacagtcccacatccaaaaaagacttcgaacccagcacactaaattctatacttttaacaacccccttgtaaggaggttttatatatatggcaaagtatttatttccggcgatttttgatgcaggagaagacggaagcgacggctacacaattacctttcccgatttacccggatgcatttcagaaggcgagaacgtggatgatgctatgagcatggcaaaagatacgctcgaaggctttctatatggcatggaagaagacggcgaagacatcccttccccatccgctccaaaagatatcaaagtgccggcaaccggttttgttgttatggtaagcgcctggacagatattgtccgtgatgaaatggaaaacaaagcggtgaaaaagacacttactgtacctaaatggctggcggaagcagcagaaaaagaaggtgtaaacttttcacagcttcttcaatttgcattacgtgagcggcttggcattaataaaagatcatcataaaaaaaagacagccaatttaagataaacaaaaaaggctgtcaattgctcaatttttcaatttttaagcgggatcgttcaatattcttttgaacggttcctttttttatattgagtaaagcggctatttcttcaaaagacaaattttgcacagcgtgcatgataaaaatatctttctcgcggtctgtcagtacagataaagcatccgctattctttccctatatcccaatcgcttgaatcaggctcactgccggtatacctttttaatatctgtcaatgcgcttttatattcaatgattaaatccttcatatgtttcctcctgttatttccccttaaaaaaggcgctcccggatcgtttcatcctttgccaatcccaaggtaagggaagcgctcagatgaatcctacgcatttatatcagcatttctttgccgccttttccggaaaacaaaaaacggacaccaatcagagcacagtaaatctgtacaatgatcagtgtccacaggctttccgtctagggcttacttaaacttttcgctttatcttctttctactacctagtttgatttctttctctaataaatatccttgtaaaatccgttccagttccttatatgcttttttttcactaaaaatacttaatgtgggtaatgctttaaatgatgttgcaccaataaaccataacataattgtaatagaaccaagagttaataaaaatcccttaaattctactaaactggctgattcattaatacttgtggtaaacaataccccaatatactaacaggtattgatactacaatagacgggatcacaattttcagaaatgaaccaatggaatataactcaagattggagtttttcgatattatataaggtaaaatgcgtttttcaataactttattgttataattttttctgtgtaaatatttttttaaggccttataagaaagtgaataatataaatcacttattccccatttacgatcaaccaacatagcatatttccttaaagtaaccgcaattatcaccataattggaaagattgaaaggcttatagttaatataatggcgttagacttcgaaatatctaatttagcagtcaaatcttctaatgaataatataaattcttaaacaaaaatttccttccgatgaaaaagtaagctattatactaacaactccaagaaagaagtaaagcctctttttccatcggtctcctttagattttaggaaagacgatgcccaaaacacatttttgacactcttagcacattttacctcttgtgccatcttaaatatttcaacatctatattcatattaacactcctccattaatcttaccatctgaatgacggatagtttcattaatttccaatcaaataagatttcattattattctccaaatcccttgctcttgtctccttttttaacctgttgttcttatccaacaaataaggcgtctattttatccttaaattttcctgcagataaaaatttagcaacctattcctgatccttgctctaaaccaaaaaactcaattagcaggataagagaataataattatgcctcagtgtttctctatagcaatctctaactgtcaaatctacgctccaaatcaggaacaaaccgtattctttaatgaaactcagttaaacagttttgaccggccgtttcgctgcttttaactttgctctcgctttacttttcgtaataattcttccgatgaagaaacccaatgacaaccgcgaccaattcaatttgttccgattctcttatgtcctgccgctgttcaacgctccgtgaaagctgactgacgtaataacgcaaatatccaactcgcaggccatatgttttacatgcggctgattttgatggcggtcaaaaattccgagatcggcagaaccgagaaccccgtttacttgtaaaagcaatatttccaaggatggaatgacatttcaggaactgcttattcaaggaagaaaatacccactccgcaaaggggccgatataaaataaaaaagcacccaacccgggtgcttcatacattaaaatcatcgtccttccttcttcaatcacaccatactcagctgcggttcaaataattcatagtgaatcgattccagcgttgtattgaattcagaaatcagctttttcatttctttaatgaacgacggggatccgcacaggtaaaaatcagcatctttatctgtcatcacttcttctaacagctgtttgtcaatccggccttcccgaaaacgaatgttttctgaacggtcttgttcggacggctcactgtaaataaagacggtgtcaacggatgagtgttctgcggcttcttcagcttcatgccgcagcgcatgatactctccgctccttgccgcatggataaagagaacgtttcgctgcggctgggttttggcaaccgtctttaacatgctgatcatcggggtaattccgacaccggcactgatgagaaccagattctttttggaatcagggtctaatacgaaatccccggccggagcgctgatctcaattgaatccttttcgtgtaattggtcatgcagatatgaagaaacaattccgtcttttttcacggaaatccggtaataatccttaccggatacatccgacaaactgtactggcggacatgcgtatagcccgtgtccggaatgtatacttttacactgatatactgtcccgctttgaattcggggagaacttgtccgtcttccggttttaaataaaacgacgttatctctttgctttcttttacctttttatcaattttaaacgccttatcgtctttccagccgcctttttgcgtttccgcttgttcatacatgtccttctcaattccgataaaagcatctgcaatgacgccgtatgctttttcccatgcctgaatgacctcaggagcagccctgtcttttagcacatcctttatcgagattaacaagtactttccaacgattggataatgctcgggcttaacaccgatactccggtgcttatggctgatttgtttgacgacgggtactatgttttccagccggtcaatattggctgcggccgcaatcacagcattcgacaaggccgtacgctgtgtttttttcttttgattcgtctgattaaagatattcagcagctcagggtgatgctgaaaaagcaggtcataaaatcggcctgtgatttcttcaccacgctcttctaagaccggcactgtgcttttaatgatttcaatcgttttttcatcgagcattctgaaatccccctaaagatgtatgcatctcgattgacctgagaaaagaatcgtttttgaattcttttttatagatttccccgttcaaaaagggttagccataccaatttgagacggattcaggaaaaaccagaaaaacgaaattgcagctgaaaaattgtggacttgccatggtgtacttgtccgatgcaaaatcctccttttcagcatttaataaagtacgggaggtgagatgaatgggtaaaaaatcgaaagtgtattactgtgaccctaagtatattgtgactgacaagtatactgacaaagaagtggtttacgtccatcccatcaaacacattaacagagaacatatccgttatgttccccgccacgtttatcaggaagaaacaattcacgaagtcattgatccgggcgaaccggggaaatgcgggtgtaaaaaggataaaaaaagacgcaaaaagtaattggttcgatttcttgccttatctcaagttaaacacgtaagtttcagcagacctccgtaccttttggctcctctttttcagaggggtctttttttcatgccgtatcttcaagcaaatacgttgtgaggcggcaatccgcctgatattcttgtcatatacaaattcacaggaggcatgatgtatgagcaaaaaaatcgcagttctgatgacagatcaatttgaggatattgaatatacaagcccggcggaagcatttaaagaagcgggacacagtgtggtgacaatagatttggaagcagggaaagaagtgacgggcaagcacggtgagaaagtaaagatcgatcaagcgatctcagacgcagacccaaaggaattcgatgcgttattgattcccggaggcttttcaccggatcttctgcgcggagatgaccgcccgggtgaattcactaaagcattcgtggaaaatcagaaacccgttttcgcgatctgccacggcccgcagctgctgattgataccgaccttcttaaaggaaaagatatcactggattccgcagcatccgcaaagacttaatcaatgccggcgcacattataaagatgaagaagtcgtcgtgagccataacatcgtaacgagcagaacgcctgacgatttggaagcctttaatcgtgaatcattgaacctgctgaaataagcgaataaaaatgcacagacccgttcagtctgtgcatttttttatggatttataaagaaacaccaatcgttagacctattctcttccccatccataataagtaaaataaagagtgggtttttcaacactcgacgggaggttcactgatgtggatgatcattttgctgctgatcattttaatcggttttaccggtaatatcgtctcgcttttgagagcgcaaaaacacgcatctcaaagaataattgagcttttagaaaagcaaggccgaaaataatctgttagcgctgtgttacccataatagtaataataattccggcagatttcctgaaatatgatttgatgccctttctcgttcggatgaagaccttctgacatgcacatgcttcggaaagcgggattatacgggtcgatgagatctgtatcaaacaggtcggcatacggtacagagaggagtgtgcaggcttctttttgggctttcacatagtcagccagcttcaggcccagtttatttttatcagtatcacggcggacgatttttccttttgatatttttgcttgtctcgttggggtcaccacaatgatgctcgcgcctttatttccgcttcgcagctgctgaatcacttgacagaagcctccgtaaaatgtggtgatatccttttcatctgtgccgatgggaatgtggttgcaccaatcatcatctgttccctggacaataatgacatcatgtccctttgttttaagcgcttgctgataaatgttatcgcttccgttgttgctcatattaacgccgctgacagagagattggttatttcagcgtctgtccggtctttcagaatgtcaccaaagccgtattccgcacgcagcccccgggcgacgctgtcacctaagatcgcgatctttgaagccttccgcagcctgcttatgctgatgaagtcaacgctgatatgcccgctgtccgtgatatgcaaaagcttgctgcttatgttttgcgaagagactgtctttccttcagagttataaaagtcctcattcagcttcattcggcgtcatcccttcctttttatcctccggcatctttttttgacacgaaaaacggacacgaacaaacagcgccatgttgtcagttcagtgtccgcagatgatgataccggatcttttatgcagttctcttgccattatagcagatctccgttacttgtaatagagtctgcagtcagcatttaaaacagcgcttgcgggtacgtttttgatgggaccgtctgctgcgtgaacggtgtgtccggtgatggctccgtcttctgctgcgggagcggtgtgtccggtgatgactccgtcttctgctgcgggagcggtgtgtccggtgatgactccgttttctgctgcgggagcggtgtgtccggtgatgactccgttttctgctgcgggaacggtgtgtccgttttctgctgcgggaacggtgtgtccgttttctgctgcgggaacggcccgaacattttttggaaaccggttcttggtataaatactcccctaaaccttctctttccgcaacggcaactccatgttcaatttctttaacagaaatagcgttcaattctgttcacctccctttttctttacaacataacgtatgaaatgtatccctcacgtgtataagcttctctctcatatgagcgagaaatggacatttgtacaacaaaaagacccgtgggaacgggcttttgcaggcattttgccgggaacaaacgcaaacataagatcgatttatttcttcctctcgctctccggctcggggtgaatcattacctgtgcttgtttgaattcatccgtaatatctctttcaatgcggtcacacaggtcgtgcacgtctttaatcgtcacgtgagaggctacgaccaggtgaaaatcaatatactcttgcgggccggagcgtcttgtacgaaaatcgtgaatttcaataaattcctgttgaaatgtttcgataatctttaaaattgttttttcttcctcttccgacaaacgggtatcaatcagcggcgggaatgcttctttcattaatttaaacgcttcatatatgatatacaccgccagcaccatacctataatgggatcaagtatgtaccactccgttaaggtaacgaccaaaaggcttgccgctacgcctaatgatgtgtacacgtcagtcagtaaatgcagggcatttgatttcattgccacggaattaaccttttcggcttctctttttacgaacttcgaaacgatcaaattaatgagagcccccgcaagcatcacaacaattcccaatacgggcagatgaaccggcgccgggttcaccagtttttgaacgcattcatatatcatccaaatccctgccgcaaaaatcagaatcgtctcgatggtccccgacagattctcgacttttccatgaccgtacggatgccctgtatcagccggcttttttgaaatcctgacggagataaaggcgatgaaggcggcgatcaaatctaaaaaagaatgaatggcttcagaaagtatcgcgacagatccggttattatccccaccactattttgagcatgacgaccagggaattgcttataaccgataaaaaagcgattttagaggtgttttccaccgtgatcctcctctttttgacttcttgtatttatcgtatcaaacggcattcgtgtgggtctacggcaacgtttttcacaaaagccatacatgtaactcatcataaactaagttggaaagcgacaaaacaggcaaacctttctttcagcactcaagtcccattgacaagatataaccgcttacattatagtagtttcatgaataaccactacggaggatgtttatggacgatgttctgaaagaattacagaagtttggattttctcaatatgaatgtaaagcatatatcggcttgttgaaacactcgcctgttaccggatatgaaatcagcaaaaggtcaggcgtcccccgctcaatgatctatgaggtgttggggaaattagttgataaaggcgctgtccatattgtaccgtctgatccggttacatatgccccgctggccggaaaggaattaatcgaccggctccggcacgatttcgagaactcattcggctaccttgaggaaaagttattggcgctggaaagcgagcaggagatgaatgtcatccgccgcatcagcacgaatgatcatgtcatcaatgagatgaaggatatgattgaaaaagccgaggaagagttgtggctgtctgtctgggaacagcagattccctttattcaagaagccgctaataaacgcgccgccgaacaattgcccgtcttttcgattgtgttcggccctccggaagtgaagctcggaaatacgacaaatcataatatgtctcctgaagtggcggagaaacggatgggcggaagattaacgatagctgcccgagataataaagaagtcttaatcgccaatttttctccgcagacgaatgcctgggccattaaatcagaagatcccgctctcgttctcgtggccatggaatatatgaggcacgatctgatgttcgcagagcttgtgaaagaagtcggggctgaaaaagttgaaggcctgatgaaacaaaaccattcgttatttcatgtcgtcaccggaaatcggttcatataaatgtgaaccgtattttctttgattttttcattagtcgttatcattataatctctatgaaaggagtataaaaaatgattaacacagaagtgcaaaaaaccgccgtttcccgggaaatgaacgatacgtttttacagggggtgcgggattgtgtgcctacgctgctgggctatatgagcatcggttttgctttcggcatcgtcggcgttgcctctcatctaagcattcttgaaatctgtttgttatccttgtgtgtctatgccggcgccgcccaatttattatttgctcgctccttgtttccgggagtccgatttccgccattattttaacgacgtttatcgtcaatctgcggcaccttctgctgagcctgaccatcgcgccgtatttcacgaaatactctctggcaaaaaatatcggcttcggggctctgcttactgacgaatctttcggagtagcggtgaacaaagcggctcagaacggcaggttatacgataagtggatgaacggcctcaatataaccgcttacatgtgctgggttatttcctgcgtgatgggcgggcttctcgggcaatggatatctgatccttacgcgctcggcctggactttgctttgcccgctatgtttgcggcgctgcttgtgctgcaattgcagtcatccgcttcggaaaagctgaagcacagcctctccttaattctctatatgatcatttttatggtcttgttatcgtatttcgtcccgtcacacatcgcggtcatcgtctcaaccgtgattgtggcaacgatcggggtggtgacggacaaatgagcatcagcacacaaatgatctggattatactcggctgcatgattgttacacttgtgccgcgcattgttccgtttatatttgtccggaacattcagatgcctgaattggctttaaaatggctctcctttattccgctttgcattttgactgctctggtaacggaaagcatgattgtgaaaacaaacagcgctttgacctttgattggaaagcaatgatcgttctcatcccgacattgctttgtgcgatgctgacaaaaagcttatccatcacggtcatcacaggagtcgtgctgatggccgccgtcaggctgatatggtgacaatcaaaagcctccattccgcagaatggaggctttacctttatgatatcggattttcttcttccgtctctgattcctcggcttcggcttcggcgtttatgctttgctgctgttcccaatgatcccgttgcaatctttctttggcgatggtaaacataaaattcacggcgcagcaccccttccctgttttgcttataccatgtactgtactcatttccccgtgcagtattcacaaaacataaaaaagcagcctgccgcatggagcggccggactgctttttatttttagtacgtgatcaggaagtattttttctttccgcggcgcagtacggtaaattgatcttcaatgcggtcttccgcagtcagaagatgcccgatgtccgtctggcgctcgccgttaatgtaaacagctccgttttgaatgtcttcgcgggcctgccgttttgaaggcgataatttagattccactagcacgtctactaaagacagttcttcagagcggtctttttcaaacgaaggtacatctttaaatcctaccttgacgtcttgagcagaaagctctttaatattgccgctgaacagcgcctgggagatatgaacggcctgctcaagcgcttcgcggccgtgtacaagaaccgtcacctcttcagcgagacgtttctgcgcttctcttttctcaggagccgtctccgttttttcagcataagcttcaatttcctcttttgacaagaaagtaaagtattttaagtatttgacgacgtcgcggtcatctgtattgatccagaactggtagaattcgtacggcgatgttttttctttatcaagccaaatggcgccgccttccgttttgccgaatttcgtgccgtcagcttttgtgacgagcggaatggtaagaccgaaagctttcgccccttcttcttctgattttctgatcagttcaagaccggccgtgatgttgccccactggtcactgcctccgatttggagtttgcagttcttttctctgtacagattcagaaaatcgtaggattgcaggatcatgtagctgaattccgtgtaagaaattccggtttcaattcttgagcttacagtatctttcgcaagcatgtagttaattccgaagttctttccgacgtcgcggagaaattcaatgatgctcagctttccgatccaatcaaagttgttcgctatgacagcggggttttctcccgcctcgaaatctaaaaatcgggaaagctgatttttaattttttgcgaccattcgacaacgatatcctgagtatttaacgtacgctccgcttttttgccgctcggatcgccgatcagtcccgtcgcgccgcctacaagcgcaatcggatggtggcctgcaagctggaaacggcgcagtgtcaatatcggcagaaggtgtccgatgtgcaggctgtcagccgtcgggtcaaaccctgagtataaacggattttttcttcgctcagctgtttattcagtccttcttcatccgtcatttgctggattaagccgcggaatgataaatcctctaataagttagtcattttgtctgctcctttgtttatgaaaataaaaaacgccccttcgtttaaaacgaagggacgatataatcgcggtaccaccctactaataaaaacataaaaaagcttttatcactctttttgataacggaccgtgtccgttctttcactactgaaagccttggaatagctttgttcgcaaaagcggttcatgagtgtattcggcatatcttatgtgctgattttcaccggccatcagctctctggaacaatcagatatcctacttgtctcaatcaaaaccttttcgtatgaagcttactcatttttaacataaataagatacgatgtcaacgccgtctttaatcttccattgtggacaggtcgcctgccggcaggttcagctcccacgccttcagcacacgtctcatgatttttccgctccgtgttttcggaagtttatctttgaattcaatttcccgcggtgcggcatgcgcggcaagcccctgttttacaaagaggcgaatgtcctccttcagctgatcggatggctcatgcccttctctgagcgcgataaacgctttaataatttctccccggacaggatccggctttccgatgaccccggcttcggcaatcgccggatgttcaacaagtttgctttcgacttcaaacgggccgacgcgctcgccggatgtcataatgacatcatcgactctgccttggaaccagaaataaccgtcttcatccatataagcagaatctccggaaacataccagccgcccggcatgaaataagaatcatatttctctttgttgttccaaatggaatccatcatcgacggccagccctttttaatggcgagatttcccatccggtacggcggaagctcatttccctgattgtcaacgatcgccgcttccactcccggaatcggtttccccattgaacccggcttgatctccatgcaaggataattgcagatgagctgtccgcccgtttctgtcatccaccacgtgtcgtggatgcgcttgccgaatactttatgtccccacttgatgacctcggggttcagaggttctccgacactcaggacgtgacgaagtgaagtaaggtcaaatttggatgccatttcatctccggcgcccataagcattctgaaagccgtcggagcgctgtaccagacgctgacaccgagcttctcaatcgtgccgtaccagttttccggactgaatctgccgccgacgatcacgttcgccgctccgttcagccacggcgcaaatatcccgtacaccgtcccggtcacccagcccgggtccgcagtgcaccagtaaatatcgtcttctttaagatcaagcacccacttgccggtctggtattgctgaatcatggcttcatgaacatggagcacacctttgggcgttccggtagaccctgatgtgtagtgaagcaggtagccgtctcttctgtccatccattcaatatcaagtctcgtgctttctccctcagccgctttatcataatggatgattttatctcccgcttctttgctgccgccgacaatgaaaatatgctcgaggtcgggcaggctgtccgccggaatccgttcggccagttcaggtgtcgtcacgacaacctttgcctggctgttcaacaggcggtctttgacggcgccttccataaacgcttcaaataaagggccggcgattgcaccgattttaattgcgccgagcataataaagtaaagctccggcgaacgcggcatgaaaataaaaacgcggtcccctttttccacgtttccataccgtctcagtacatttcccgcccgattcgattcctccatcatttctttaaatgtatatttttcatcccggtttgcgtccttgtaatacagcgctactttgttttttcgaaatgattcggcatgacggtcaatcgcttcgtacgccgcattcagcttccccgtctgatgccaggaaaactccgcttcgacctctttccaatcgaagctgcggtacgtttcctcataatttcgcagatgataattccccttttccgccggcaacgctttcaaattcatgcaacatccccctttgcttatctatagactaattatagtagatgttcacagttttctcaatttttaaaatataaattacaacactattgaaaacgctttatattttgttatgcttaagagagatgtgtttttattaagaaccgacaggcggtgaatcagtgaaacatcataaaacgtaccattcttcatcaattcagacagcagccggccctctattggtagaagggcccattcctccagaggacctagcacagtatgagtttcatgaaggcctgacagcctttcgccttcctcatgaacagcacaaagcgttaatcgagatcgccaggcttcctgaaggtcggatcattatcgccagggacggacagacgattatcggctatgtgacgtatttatatcctgatccgcttgaacggtggtctgacggaaatatggaagacctccttgaactcggggcgatcgaggtcgctcccggctacaggggctgttctgtcggaaaaacgttgctgacagtcagcatgatggatgaacagatggaacggtacatcatcatgacgacggaatattactggcattgggatttaaaaggaatgaaaaaagatgtgtgggaatacagaaagatcatggaaaagatgatgaatgccgggggtcttgtctggtttgcaacggatgaaccggaaatcagctctcatccggccaattgtctgatggcccgcatcggcaggcacgtcagtcaggagtcaattgaacagttcgacaggcttcgtttttatcagcgatttatgtattgactgacatacaaaggggataaaaagatgattgcagaacaaatcatgaaacgggacgtcatcaccgtctcaaaacacgactccattgaaacagccgtccgtaaaatgaaggtatatcatatccgccatctccctgtcatcgacgacgagctgcacgtcaccggtattgtcacagacagagacattaaacaggccggccccggcagctttgaacaaaaggaacgcggcgcgtttctgacaaacaaagtggagaccattatgaagcgggatgtcatctgcgcccatccgcttgactttgtggaagaaatatccgcctccttttatgagcacggcatcggctgtctgccgattacggtaaaccataagctgacgggcattttaacgaaaaccgacgtgctccggactttcgtcagcctgacaggcgcggcccagccgggatcccaggtggaaatcctggtgacggatatgacaaaaagccttgctgatctcagctgcttgtgccgtgatcttcagcttcaaatcctgagtgtgctcgtctatccccatgattccgccgggtcgaacattctcgtcttccgggtgaagacgatgaatccgctcccttttatccgtgccgttcatgaagccggatacaatgtcttatggccgaagcatttgagggatcagccatgaaagacagcgtttttgtttattcgccttcttatcagacgtatcaatttcatcaggatcatccgttcaatcagcagcgcgtgcttttaacatacgatctgcttcaggcggcggacgcgtttgacgaaggagacatcgtcattccgcgcacggcctctaaagaagagctggctctcgttcatacagaggattatatacaggcggtggaacttgcgggtgcgggccggctccctgccgcagaaggagaaagctacggtctcggaacggaagacacccccgtttttgccggcatgcatgaagctgcgtcgcttctggtgggcggcaccttaacggcggctgattacgtcatgacgggacaagctaggcacgcctgcaatttaggaggcggccttcaccacggcttccgcggcagggcgtcaggcttttgtatctataatgacagcgccgtggccatccaatacatccagaagaactacggggcaaaagtgttatacattgatacagacgcccaccacggcgacggcgttcaatttacgttttacgacaggtctgatgtctgcactgtttcttttcacgagaccgggcgttatttatttcccgggacggggcaggtactggaaaaaggaagcgggcaaggctacggctattcttttaacattccgctggacgctttcacagaggacgattcctttctccacgcttacaaaacggccgcctcagaaatcgcggctttttttaagccggatgtcatacttacccaaaacggtgcggacgcccattattacgacccgttgacacacctgtccaatacaatctccatttatcaggagatcccgcggctcgctcattcattagcccatcaatattgcagcggcagatggatcgcggtcggcggcggcggatacgatatttggagagtcgtcccgagagcatggagccgcatttggcttgagatgaaagggattgatcccggggagcgcataccgcagaaatggattgataaatggcagaagcactccccctgcacgttgcccgctttttggagtgatcctgaacaattatatcctccgattccccgcaaagaagaaatttcagaaaaaaatgcccaaaccgtggaaaaagcactttttgccatccggtctgagcagcggtataaaacaaaataaaaacgaccttatgaggaggtcgtttttttgatcacaatttctacacggcggttttctttcatatgtccgggacttttgttgtccttcacaggtttcgtatccgcatacccggcagagataaaccgtttggcggaaaagtcttcattcgcggtaaaataccggatcacactcgccgctcttgcagaagacagctcccagttcgacgggaattgataggtggaaatccggcggctgtccgtatggccctctacctgtatgttattcggaattgtttttaaaagcaccgcgatctgatgcagaaccggctcggcgtttttcagcacatccgcttttcccgtctgaaacagaacggcctcctgcagcacaagaaccactccgcgctcatcgcgcttcgccgtcaatttcgaactcaaatgatgcgcttttatgtatgtcttcacgttttgtaacagcaaatcctgttctttattttcgtttgctttgtctgatgacgccggttcacccccgccgccgtttgtatgaatcgatgaaacggcagattgaaatttttccgcgtctatttgcgacatcgaaaaaagcaagataaagaacacgagaatgagcgtgatcaagtcagcgaacgtcaccatccatctcggtgaaccgccggaatgttccggtttgtttcttctttcaaaacgctcttttctaagcttcatggacagcgccctttttcttgttcgcaggctgtcctttacgccagtcttctcttgagctgaagacgacgagctgactttcgaggttgcggggatttttgcccgattggatgccgacaaccccttcgatcatgacctgtttgatgaaaatttcactttccgttttttcttcaagctttgccgcgattgggataaacaccaaattggcaagcaacgctccgtacagcgtcgtcaatagcgcaacggccatgttcggtccgagggtatgcggatcatttaagtttttgagcatgagaacgagtccgacgagcgtcccgatcattccccaggcgggtgcgaaatcaccggctttttcaaaaacgcgtcttccttttctgtgtctttcttccattgcggcgatctcagaatccatcaccagccggatcgtttcctcgtcccagccgtcaatcgcaagcaaaagccctttttttaaaaacggatcattgatctcccgcgcctggtcatccagagacagcagcccctgcctgcgcgcctgctccgaaaggctgacaaatactctgacaagctctttcacattgtcatcctgacgggagaatacctgtttcagaacagaaggggttttctttaaatccctcggcggaaagctgataaagaccgccgcggcaaggccgcctgtgacgattaaaaaagaagtcagatctaaaaatgaactgattcccgccagtcccgtccctgacagaataccgattgcgacgataatacagcctaacataaagccaacgggcgtcagataatcaaaacgtttcatatcttctccttactcaagtaaaaaagcaagattccacccctcagagtgaagcttgcttttccgtttttttatgacttggttgattgtcttaattcgatgcggtggggcaattcgacgatatgctcttcaaccggctctttgttcatcagttttgtcaaaagtctcatcgccacggcgccgatatcgtacgtaggctgcacgactgttgaaagctgagggcggaccatcaggctcaatctcgtattgtcaaaaccgataatatcaagatcatcaggtatcgaaagaccttgatcttgggccgcatggataatgccgagagccatttcatccgtcgcagaaagaatcgccgtcggtttccggtcaaggcccatcaagctttgaagcgcctccataccggaatcataagtgtaatcgccttccgctacgaattgctcgttaaacggaatcgccgcttcttcaagcgcccgtttgtacccttgcagttttttcgaacggttgatcggctcttgcatcggtccggagacgaaagcaatatcacgatgccctttatcaatgaaaagcttaacggcatcataaatcgcctgttcataatcaatggcgacagaaggcgtctcgccctgttcttccactgatgcagccaagacgatcggcacaggagagcgcttaaattcttcgacatgctcgtccgtaatgttgccgcccataaatacgataccgtccacttgtttgccgagcatcgtatttaacagatgcagttctttctcaagattttgatccgagttgcttaaaataatattatatttgtacatcgtcgcgatatcttcaattccacgcgcaagttccgagtagaaaatgcttgagatatcagggatgatgacgccgaccgttgtcgtttttttgcttgcaagccctcttgccaccgcgttcggacggtagccgagccggtcaatggcttccaatactttttttctggtcgtcggttttacattcgggttgccgttcacgacgcgggaaacagtcgccatactgacatttgcttctctggccacatcgtatatcgtaatgttgctcactgaaaccactccttttactggatacacttatccttatctatagcataaacactttatgtaaagaaatgtcgtacgatttcgcattctgtcgtttatgattgtaagcgtaagtcagtagtgtacattatttttcattattcatcaaatttaaatatctctcatgaaattatacacgtttttcccagtgatgaaaacgttcactttcattttataattaaataaaatgaagatacgaaaaaaagccgcgcgaggcggcctttaaagagcggaacattgtattatgcttttactttcagcatcggctttaattcgttcagccatttctcgaattcagggatatccatctgctgcgcagagtctgacagggcaacggaaggatcagggtgaacttcggccatcacgccgtcagcgccgatcgcaagcgccgcttttgctgtcggaagcaggagatcacggcggcctgttgagtgtgtgacgtcaacaaacaccggcaagtgagtttcctgtttcaaaatcggcacggcagaaatgtcgagcgtgtttctcgttgccgtttcgtacgttctgattccgcgttcacaaagaatgatttggtcgtttccttgtgacatgatgtattcagctgcattgataaattctgaaattgttgcggcaagaccgcgttttaacaataccggctttttaacggagccggcggctttcagcaattcaaagttttgcatgttccgcgcgccgatctgaatgacgtcaatgtaatcaatcgcttgctcaatgtgggcgggcgttacgatttcactgatcaccgcgaggtcatattcatcagcgacgcgtttaagaatttgcaggccttctacaccgagaccttggaaatcatacggacttgtgcggggtttaaacgcgcccccgcgcaggattttaatgccttgttttttcgcggcggccgcgacttcggcaacctgctcatagctttctacggcacaaggtccgacgatgaatctctgatcgccgtcaccgattttttcgcctttaatgtcaacgatcgtatcttctgcttttttcttccgggagacgagcaacgctttgctgtgatcctcttcttgaagttcaagtccggctttgaaaatttctttgaaaatatgctggatcgttgagttttcaaatgggccgtcattgctttcaataatgcggttaagcattgtacgctctctgacagggtcaaatcggttgacaccctgtgcttcctttgctttaccgatttcttttacaacggctccgcgttcattgattaatttaaggatttctaagtttagtgcgtctgcctgctgtcttaggctctctaattccttgttgctcatctttttcatcccttctatgctatgttttattttaatggttaacatgcatcttactacagttatgcgaaaataggaatatgaaataataaattttttcacattcgactttatcaccaaaacgcttttaagcttttatgcgttgaagtagtatatattgatatcctacatgatccggctgaaatgatcaatagtttttttcaaaaaaaaaaccgccggtatcaaccggcggccagcaattatgaaaggtgctgctctattgcgttttttgtgatttgtgaatgagacgcgtgccatttcacttcgccgtttgtaatgacgaatacttgcgggctttcatgtttcacgccgtatgtctcggcgatatagtttgaaagcggccggctgtcctgcacatgcaggtaataagaaggtacttctgaatgctccgatgcaaaggcgtcaaactcctgaaacgcggcttggctgatcgggcaggttgtgctgtgtttcaaaaacacgagcgtgttttctttctcagcggcatttttgaactcttcttcagatgatatcagctgttttgtcatgtcggttatctctccttattgaaggtcagcgatttgcctgaccggctttttccccggcgtcttccgcttcggccttgatgctttgggccgtgtcctgcatttcgcttctcgtctcttcggctttctcggttagtgtgctcttagaacggtcttttaaatccttcactttattcataatctggcctgactgatcagctaccagctgggtgatattagatgttttgtccttggcgatgctgacatattgagagcctttttctttcgcatcggccgtcattctgtccgtcttatcctttaacgcagaagcctgactgccgagatcgtcgcgcagctccttacctgatttaggcgccagaaacaacgccgttgtcgcgccgataattcccccgatcagcgttccgattaaaaaatccttactattgattccatctttgctcattatgattcctccttagtggatttttcttatgattaaagcgatgtttttttcttttgcttccacttgtcccatatttccatagcggcctggctccaggtgacaacctgactgatcttatcctgattctctcttacagaggccgtaacggaacctgctgcctgctttatggatgtattaaactgctggacggaagttcccacttcctgaacagcatggacaaccgtatttaatttctctgatttttcctgaatgtcttccgcgagacggtttgtcttatgtaacagctcggttgtctctgcggtaatgcctttcatctgcccttcaaggccgtctaaagtcgaggctacgtttgttaaagtcatctgcacggactttaatgttttggacagatagatgacgaggatgagaaatgcaacggcaatgagtgcgacgcttaagtaaagaatgatgatcatctaatacctccttataatgcaggatatagtggtatatacccaattctcaaaatgataaacatatatgaaaggtctgtatgtatactatttctccgtttatcggtaaatcccttttgcagcacgcgcaaaaaagcagtgagagccccactgcttttttgttacgctatgacgttttcataggctctcatatatttttgaatgtctccggcgcccatgaagatcagcactgcgccttcatgcgctttcaacacggatgtgtcattttcttcaatgagttctgcgttatcgattttttcctgaagatccgtgatcgtgagcttgccgacgttctcgcgggcagagccgaaaatgtcgcacagatacacgcggtcggccgcgcttaagctttctgcgaattcatccaggaatgattgcgtccgtgtaaacgtatgcggctgaaataccgcgatgatttcacgttcgggatatttttggcgcgccgcctcaatcgtgactttgatttcagtcggatggtgggcgtagtcgtcgatcagtacctggctgccgatcactttctcattgaatctgcgtttgacgccgccgaatgattcaagtccgagcttaatcatgttcacgtctatctcttcatagtggcagagcgcaatgaccgctaaggaattgaggacattgtgatggccgtatgccgggatgtagaacgtatcgtaaaacgtattgcggacaaagacgtcaaatgtcgtgccttccgtattttttacgatgtttctcgcttgaaaatcgttttcttctcccgtgccgtaataaacgactggcacattggcgtgaattttcggcaggtactcgtcatcaccgcaggcaatgatgcctttgttgacttgaagcgccatgttttggaaagcatcaaacacatcgtcaatgttggcgaaataatcagggtggtcaaaatcaatattcgtcataatcgcataatcaggctgatagcttaagaaatgacggcggtactcgcaagcttcaaatacaaagtattcgctgctttcatttcctctgcccgtcccgtccccgataagaaacgaagtcggcttcgcctgctgcatcacgtgtgccaagaggcccgttgtggacgtcttgccgtgtgcgcccgttaccgcgacacttgtgtattttttcatatattcagctaaaaatttatgatatctgatgacaggaatcccttcatcgagcgcctttgcgatttccggatgagaatcaggaaatgcgtttccggcgattaccgttaagccgggtttgatgttatcggcgctgaacggatagatcgggatatttcttttttcaagggcagcctgagtgaaaatctgcttctcgatatccgatccctgcacctgataccccgtatcatgcaggatttgagcaagcgggctcatacctgtcccttttattccaacaaaatgataaacagtcataatcgtacctccaacaaacgtctatctgttccccagtatatgacgctcatttcattttgcgaccgcagcgggcgaaaagcccgcacagcggcgcttccatttatttttacgttatcgtcagtatctgtaactttctttttgattaaacctgccgcatgatatttcagcgcgtgacagtgatgcagttttgatggtccatccactatcataccatgtttgtgagaaaaatgaacgatattcttattcttgagaaatgtcagcggccgtaatcagcacttcacggggtttgctgcccttcgcttctgagatcatgccttcggcttccatcatgtcaatcagcctcgcggcgcggttataaccgattctgaaccttctttgaaggcttgaggtgctggcgctgttttgctccacgacgaattggcacgcctcaggaaacagttcgtcttcttccttaagggcggttccctgcctgatcagttcttcctgttcaaacaaataagaaggcggcagctgctttctgacatgagagacgacgcggtcaatctctctgtcggatacaaagttgccctgcaggcgcaccggttttccggtaccgttttcccagtacagcatgtcgccttttccgagcagcttttccgctcccgccatgtcgatgatcgttctggaatctacctggcttgagacggagaatgcaattctcgtcggtatgttcgccttgatcattccggtaatgacatcgacagacggacgctgtgtcgcgacaagcagatgaatgccgcaggctctcgctttctgcgcgattctggcgatgctttcttccacatcgttcggcgcgaccatcattaaatcggcaagctcatcaatgaccactacgaggtacggaagcttttcgcctgtcttatgatcggccgttaattcattaaagcggccgatatctctcacacccgaatgggcaaacagttcataccgccgttccatctcttccacaacccattttaacgcggcggtcgcggctttggcgtccgtgatgacggggctgaccaaatgcggtatttggttataaggcgcaagctcgaccattttcggatcaatcagaagcattttgacatcactcggatccgccttataaagcagactgaccaaaatggtattgatgcagacgctttttcccgatcctgtcgcacccgctatcaacccgtgcggcatctttttcaaatcaatgacgaccgggtttccggaaatatcgacaccgagcgcggcggtaagcggagacggattcgtcctgaaagcggcgcttctgatcatctgccttaaatcgacgactttgcttacgcggttcggaacttcaatgccgatcgtgtttttaccggggatcggcgcctcaatccgaatatccttggcagataaactcagctttatatcatctgctaagtttgtaattttgtttactttcactccgggctcaggatgcacttcaaaacgtgtgacggacgggccttgtgtgacatgaacgacttgggcgcgcacattaaagtttttcagcgtaacgtttaaaagctcgcgctgttcttcaatccacgattggtcgtcatgtctttgcgccggcggtacgtccagaagcgacagattcggaaagacatagctcgctccgccctctggcgtcttcgtctgcttgtgtttatcgcttttaagcatcatgacgttaaacggaacattgcgctctttcggccgctccgcttttctcacagtctgaggctgtccgtgatgctccgttttttcctcggcgagccgggacggggcatcagccgtctcaatgcttgcaggttcaggctcaaggtctgaatgccggtctgcttcattgtactcaggctgagagtctgcttcctgtttcgcgtcggtttcagctgattcgggcttgtcttcagactgcggctgaacttcctcatcgtatccgggttctgtgtatgtatacaccggttcttctgcggtttcaaaaggaggtgctttttccggctcaggctcctgatattccccctgcagcgccgcttgttcctctgtgttttcagccgttcgggatgcttcatactcaggctctttaataggctgcggtcgggtttgttcatgctcttgttcttctgtaaagccggcagactccgcgctttcggtgtgctcccgctcttcagcctgctgcggttctggtgctgcaaacacttgctcttttgcattctcagcctcggtgtgaagctcctcttttttaacggcctggatttcttccgtttcttgtttcgcaaacggttctggccggtcattcgtctgttttgttataccggatgttgtgaagacgggctctttttccgtttcctgaccggattttggcggaacaaattgctcctctgacagcaatgttacgttctcttcacgccgcttttcggaaataggcgctttttttatgctgtgctgagattgaaagccgtaaaccggtgaaggaatggatgacggtttaaagggctttttcacggcatcaggctctttatgtgtatgctgtttccgctcggtttgctccttcccggcggcataaccccgggacggctggcggcgttcgtgcctttcccgctgtctttggttttgctccgttcgcttatagccgtccggaacgaccgggaagcggaaattccctttcggatattcgtaatatattttaggatcttccatgcgcgttaatttgccttctggctgatccggtatgtgctgtttcgggatttgggcatgcgtgttcggttcacgttcatgctcttcttctttttcacctaaaaataagtcaaaaaatttattcagccaactcatgtttaatcactctctaactccctttttagtagtctgggacgatatttagtataccattgccgggcggttcagaaaagattaagctcccaactgaagaaagccgttaagcaggcctgcttaacggctttctctcacatcattcgattctgtgcgcttatttatgggagttagaattgaaatgcttcgccggcctcgcggctgtcttcaagaacaagaatccctttttccgccggcgcatccggcaaagcgagttctttcgcggagcagatcatgccgcttgacggaacgcctcttaattcagcgtctttaatcacaagtccgctcggcattaccgcgccgactttagcgacgacgactttttgccctttgtccacgttcggcgcgccgcaaacgatttgaagggtttcctctcccacattcacttggcagatattcagtttatccgcattcggatgtttttctttcgattcaacgtgaccgacaacaaatttcggagaaaggtcaaccgtcagcgtttctgaaacgccgtttctgttcagtatttcattcacatcctgaacgaatgtctcagacaaagcgacggggccgttgtcctcaatctgtaagtaagaagacacgttaaaaatgttaaagcccgtcgtttcttttgtttctttgttaaagattctgacgacatcgccttctctttcatagccgatttcttcgcgtgctgcatctttaagagagatcagaagcgtatctcccacaccttctttattgtaaaaagcgttcataagaaaaatcctttctaatcctttttcggccggcttttcgccatgataaacacaggttccagtctgccttcattatacagaaatgaaagggccgtaatcggcaccgtgccgcttgcaaagaagctcatggacatttgccctaaaatatcataacccgattcatttcgaatgtcagcaagtattaatacatcctgatgcggaacggaaatcgctaattcgccttcagcggcctgcttgtattcatgaagaatcgaatcattgagaatccggctggcgtcatagccgtcattcgccctgaaaaaataaaaataattgtccgcaaccgtatcctgtttcacgaccgaaggaagagagcggagattgaatgacgccgtctccctgatgcgttcttttgtccagctttctttctcgagcatacggctgtcaattaagcggtacgtcttaccgagatcaagcgcgtagtagattctcgtttcggccgtatggtcatcatacacgagcggaatgccgtcgctcgtttgatcgggaaatgacgtagagcggatgaccggatagattccggcttcctttccggacatctcctgtccgctgccttccatcgcctccatcgcttctgacacatagtagacgatttcgtcgatcgcttcttctttttttgtctcccacttcgcaatgatcggcgggagctccaatgtgatgccttttttggtcgtttgatcctcaacacggagggtgtctttttctctgtcaaaaaagaaggatcggttctcgtgctgcaggcgctgttttaataaatccgccagcttccttgacgtcattttcaaagcccgtggcctcctttatgctttagcaagggaatcggttaaaaattgctcaatttcttcttttgttttacggtctttgctgacgaagcggttcacttcttttcctccgttaaacacaacaaagctcggaatgccgtaaatttcccattccgcgcatgtatcaataaattgatcgcggtctacgtagtaataagtgaattcgggaaagtccgcttccagctcagggagaaacggctccacaaagcggcagtccgggcaccaatccgctgaaaacataaataccgcccaatcgtcttgtaccgctttttgcaattcttccgtgctttcaatctttttcattgtcattcctccatctggattatgagttttttatatgctgatgtttgtccaattggatcataccagactgtttacggcaagaccaactatatgcaatatcattatcatatttcatttgcattatcaagcaagtttcgtttaccattttgcttgtagccgtacgaaattctgaatatgtacataaggaggggcaaaagatgcagtttgtcgtgtatttagccggtgaaatccacagtgattggcgggatgaaatcaaacaaaaaacaaaagcgctgaacctgccgattacgtttgtcggcccgatggaaaaccatgaacgctcagacaatatcggagaagagattatgggcgtgcagcccgattctgttttaaaagacgccagagcttctgatatcaacaatttccgtacagaggtgctgatggaaaaagccgattttgtgatcgccctgtttggcgagaaatataaacagtggaataccgcgatggatgcttcttatgccgtcgcaaaaggaaagccgctcattctcatccgtccgaaagaacttcatcatccgctgaaagagctttccggaaaagcgaatatcacggtcgaaaccgtaaatcaagcgatgaaagcactttcttatttatttgaaacagaataagcaggccgcctttatgcggtcctgcttacctaaactcaccacttcagtatgaatcagttcaagaggaaattttatgtttgtcttttttgtcataatcatacctccttgcagaacaaataaaaaatgcaaatgactcgacttttgtgaaatcgctgctcatctcaatgcttgcagcatgtttttgatttaaaaacgcattgcaataaagattcgtggttgtttatttggattggaaccattttgataataatattgaaaaataatatgtgttacctaattctattttcaatacgctttaatgaactgtctcgatcatgcggcttaaaacagaatgtaaaaacagcagtcaataagtgttcaaagggacttattgactgcttatttttttacacattttctctgatcgtttcgaccgtctgtttgtcactcgccatgaccagcttaatgagcatttctttcgccgcggcataatcatcgacatggatgatagcggcatttgtatgaatgtatcttgaacaaatgccgatgacggcagacggaaccccgctgtttgatatgtggacccgtccggcatccgttcctccgcctgaagcgaaatattgataagggatattgtacgtttccgccatatcaaggacgaactctctcatcccgcggtgcatgaccgtcgttctgtcgagaatgcggagcagcacccctcgccgagacggccgaacagctccttatcaccgctcatatcatttgccgggctggcatcaagcgcgaagaagagatcaggctgaatcatgttggccgctgtctgcgcccctctcaagccgacttcctcctgaacggtggccccggcgtacagattgttcggcaggtcttttccgtgcagctcttttaatagttcaatgcttaacccgcagccgtagcggttatcccacgctttggacaatattttcttctcgttggccatcggggtgaacgggcagaccggcacgacctgctgtcccggtctgatccccattttgaccgcgtcctctctgtcatcggcaccgatatcaatcatcatatttttgatctccatcggctttgcgcgctgggcatccgttaaaatgtggggcgggatgcttgagatgacgccgataatcggtccgttatccgtctgcacctcgacgcgctgggcaagcagcacctggctccaccagccgccgagcgtctgaaatctcagcatgccgttatccgtaatctgtgtcaccataaacccgacttcatccatatgcccggctaccataacggtcggcgcatcttcagcgccgcgccttactccgaaaacacttccgagtctgtcctgcacgatgtcatccgcatatttcgcaagctcccgtttcataaaggagcggacctgatgttcatttcccggtgcgccgggaagctgcgtcagcgtccggaaaagcgttttcgtttcctcattcatattttcccctcatttctatgtaatgcttttattttattagaaaaacaactgttttccaagcgctcagattgaatgggctgtaaaaccgccgctttacttaacaccgtctggcatcttctgtataataaaaactacgacataattggaggtgcttcatattgaaattacgtcattttctcttaggtgcaggagtcggattatgcgctgccatcgcagtgaaaaagtatgcgatgaaaccttatatctcttcagaaaaagcgctccgtatcgtgaaagcggcttttaaacagcgcgggccgatagacggatcatggatttacacagagcccgagccctaccaggtaaacggagaaaccatccaggtatacaaaaccggcgtgacacgttcggcattcggcgaactggagcaatatgaagttatggttaatgcaaaaacaggccagattgtcgatgtcattgattctgtcgcctcataattcggacaagcaaaaaataaagcccaaaaccatcagcgttttgggctttattcggttacatcggccgaattcgtttatatacggggttccacatcgcgtcctgcaccgcttggatcagatcctcgggttccgtttccgctacaccgtcctgaatcgcagctttagctacggctaccgccactgttgccgataccgtcctgagatcctccactttcggaagcatcggcgctcccggcttgccgacgtccaccataccggcgatggcattcgcgcaggcaacgaacatattgtccgtaatgagccttgcttttgtcacaatcgtgccgagcccgagtcccgggaatacgagcgcgttgttcgcctgtccgatatggtaggtaacgccgttatacgcaacaggcggaaacggacttcccgttgtgacaagcgcgcggccttccgtccatttaattaaatcttcaggttttgcttctgataatgtcgtcggatttgacatcggcaaaatagccggccgtttgacatgtgaggccatttctttgacgatttcttccgtaaatgcgcctgaaacggtggatgtgccgatcaggatcgtcggcttggcctgacgcaccgtctccgccagatcaattgatccgccttcaccgctgcggccgtactctttcacttcatcagcagggcgggcgtacggaacctgaaaatcacgcaggtccttcatatcatccgttaacaatccgtttctgtcgatacaccaaaagcggctgtatgattcttcttcgcttaatccgtcatgcaccatagcttcgcgcagctgctcagcaattccgataccggccgttcccgcgccgaagacgacgactttatgctcttttaaaggcacttttgatgctttcgcacacgctaaaacagctgcaagtgacaccgcgcccgttccttgaatgtcatcgttaaacgtacagactttatctttataccgttttaatatgccgcgggcgttagccgtaccgaaatcctcccaatgaagcagcgcattcgggaatgtttcccgggcaagcgagacatactcatcaataaagcggtcatatttctcgccgcgcactcttgaatgctggtttccgacgtacagcgggtcatttaagaggctttcttgatttgtcccggcatctaatacgaccgcaagcactcgtgacggatcaattccggccgccgccgtatacaccgcgagttttccgacagaaatggcgatgccgccgacgccccagtcaccgattcccagaataccctccgcatctgtggcaacgattaagtcaatgttttcattttttccgaactgctgaaatgcggcgcgcattccttcagggtcatctattgacaaatacagaccgcggggttttctgtactcgtggctgtaacgctggatcgcggtgccgacggtcggcgtatatacgatcggcagcatttcgcctaaatgatcatttaacagcctgtaaaataacgtttcattccgatcatggagagcggtcaagtagacatttttgctcagctcatcaggctgcgaactgaattgttcgtaggcccgcctcgcctgctcttcgattgtcaatactttcggcggcagaaatccctcgagcccgagttcctttctttcctcctgtgtaaaggccacccctttatttaaaaaaggcgtagaaagcacttctaatccgcgcagagttgttttgatttctccatctttcgtcacttgaaattgattcacctgtctcttcctttcaaagcaatttgtcttaggtttgcttttattcccgaaattcatacaggtaaatcatcgatccgcctattttttctcccgtctgacagatgcagccacttcgccgtcttctccccattttaccgctctgtaaatcgcatcgtgatagaagatcagccaggcgtctttttctgccgcgaacgtctgccatttctgcttttctggaatggaggtcatcggataatcatcgtatgccagcacccatagcggatttttatgcgcattcgtcggcatcaggtcggcaaaatgcacagccgtctccccgccgtcttctaagacgatgacgctgtggccgtcgctgtggccgccggtgtggtgcatcgtaatgccttctgtcagctgatactcgttctcaaaggtttcgacctgatcttgtaccgcctcccaattttctctccaatatgtatttttcgatctgatattagggtttctcatttcgcgccactctgttgcagaagtgataatgcgggcattcgggaaaacagagacaagctcctctccgctgtattccgtcaagccgcatgcatggtcaaaatgaagatgggtcatcgccgcaatatgaatgtcctcacaggaaagcccgagttcacgaagagagtgttttaaattggattcctgtgttacaccgtaattccttttttgtttatcagaaaatttccctctgccgatacccgcgtcaaccaatagattcaggccgtttgttctgatcagaatcgggtctgttcttaattcaatctggtttttgtcatttacggggtattttctcgaccataaaggcttcgggacaacgccgaacatcgctccgccgtccatatgcgttacaccgccgtccagccatgttaatgaaatattcccaatattcaatgtctccatcttgatccctcctgatgtaatggtagcaaatggcggcataaaaaaacagactcccgcatcagagtctgtcttttgttctccattcaacttcggcccggtaaatcggctggccgagcgcggagaatttttcttcgtattctgtcataatattgcccttcggatcgctgttgtgcagatcaagactgacttccgtcagaagcaggccgtattcggaaaagcttttcagagagtattcgaataaaccgcggttatcggttttaaaatgaatctcacctgtttcgcccatcacttcttcgtattttttcaagaacgttttaaatgttaaacggcgcttttcgtgacggtttttcggccacgggtcagaaaagtttaaatatacgcgcttgatttctccccgttcaaatacgtcattcagtgtttccgcgtctatatttaacaaacggacattgtgagccccgctgtcctttactttttggacggcagtgacgatgacgcttttaaacagctcaattccgatatagttgatatccggattctgcttggccattccagaaatgaactgcccttttcccgtaccgacttcaatatggatcgggttgtcattgccaaagaccgtgttccatcgccctttatactgggccggatcactgatggcgatgtcagcgttttctgccagaaaatcattcgcccaaggtttatggcgcattctcatatgattgacacctctatctataatttcgagtaacaacataccatgaaacataaagagccgcaagcgccttttaaaggcgccggctgcataaaaaaagaggctcccccggtccggaacactcatgtgatgcataaaaccgcaccgctttgcacaatgtatgacacagaaaggatgtgtatatgaatcatgggcttaacaagcgaacatcaggtccggttattaaaggacatattggccgaccatcaattggattgctgcggcacggttgccgagtatgaacagctggagcgcgtcatcaaatcactgatggccaacaccgggcttgattcaaatataaaaaacgtgctcgaggatgtctaccgctacagccagtccggcatcacggccgattccatcgacacgcatattcaggagcaccaaaaccatttgtcccaatgggtggagcagatggattcgtactcctgactacttgacaatccgcttcatcagggcatgaagctcttccatggcatcatgatacgctttgtcgtttccttttgatttgtgccaggcgatgaaggtgatggtctccgataacatgtaccacgccatccgcagccgaagcccttccgtgagcttcatgccgtacatcccaagccagctgtcccacgctggctcttcgacgtaatgatacaataaagggccgagatccatggccggatcggctatcatggcgccgtcccaatctattaaatacagctggttgtcttctgacagaagccagttattatgattcacatcacaatggcaaacgactttttcaccgaattgcacctgatccacatgagcttccaaataagcaaggccttcctgaataagcggcgaaaattgccgcacagcaaagacggcctgcttcagctgcgacaaaagggcgcccggatcaagcggttcttttcccaatcttttcagcatgtcgagcaaagcttttgatgtgtggattttgcggagcagctcagccaccgggcgtccgctcatatcctttgccttcagctccctgcccgccatccaatgctgagccgtaatgacgtctccgttttccatccgttttgtccaaaccagcttcggaacaatgccttcggcggataacacggctaaaaagggcgagctattacgttttaaaaaaagctgttggccgttatgtttcgcataatatgcatctcctgtagctcctccggcggggaagatctcccaatcgctacctagtaattgtcccaaccagttcatatcaatgttcaacccatcatttcttaaaatattttagaataggcctccagcctttctctattggcggagcggcctgtcataaacaatttcatgagaataaaaaagacagctattgagagtctcatatgctaatcaatagccgtcctataaattttagcgctacagcacaaacttcgtcaagcaaaactagcaagaacacctgtgaattctgaagatttatgccgcgaaccgctcttttccgtgaaacatttgacgggtttcatttgtttattatgtttttattttcaacggcgcgccgcccggcataagccgaaacggcgtcgttccgatcagctcgccgtcagcgtgaaacggaattttcccatctgtttcaaaaacgaattccttcccctttatcatcgtcactccgtccattttgatatgccggccgaagctcatcgcccataaaaaacgatacagcgagaaaaaggacaggttttctgcaatgacaatatcaaaatggttttgacggggatttgctgaaggcgccgctttcatgccgcctccgtaataaggatgattagccgcaatgacaaaccagacattgcggaattcacgcctctggccgtctgccgtgcaaacaaatctgaacggctgaaaccccgaggccgtatgtaaatgcgcgagcgggtaaatcacaaaaccgagacgcaaaaaccgaagaatgcgcgataacggaaaattcacggctgccttcaaaactgaggcatcgaaaccgacagacaggtggttaataaaataaagtgattgcgctttgtcatgaaaaaagttgatgtttcccgcaaaaaatttccgtgtgagcgggcggtgcagacttttgatttcttggaggagcgccgacttcttaataccgagccctttggaaaagtcattgtacgaaccggcgggcacaaaggtcagctcaatctgatccgttcctttcagtccgttaatgacttcatgcatcgtcccgtcaccgccgatgacgaacagccgcttaagcttatgatcctgcatcattgaaatctgtctcgccagcacctccgcatgtccgggatgcccggtcaaaaaagagcggtggctgaccccgcgcctggtcagctctttttgaactgatttccagacacgccggccccgcccgcctcctgagaccggattaataataaaaaaccattgactcatcgtttgtttcacctgcttcatagatgaagagacagccggcaaacgtccgctttaatcaagccattcctgtctccggcttgaatcgctcaacccgtaagacaaaagagccttcgccgccttcagctggtggtgcttgatcggcgccgtatttttctgctgcttttccagccaccctgcggcagtccgtttatcagctatttccagcccatacggcggctccgggtaatcaatataagacgttctgctgagcaaaagcttccgcacgggaatgtcggcctgcttttcttttatgatttgcgaaacgaccgagcccgtccggtgcaggctgagagacggattcaatacttggcgcgtgctgccggagcctctttcttcccaaaaacggtgttttgatccgatatatacgctgtcctcttccgcttccataaaagcggcgcagaaaatctccagcggcgagatgatgataatgctcagttcgacggacgcctgctgaatttgcagaaccggatgatacatcacaaaataggaatcgggcagcttttgagccagcatttttaacatcctgtcccctttgaccgcctgcgaaagctcagacttttgagaaagcgtggagctcgcccattttaattgaaagtcatacagctgatctttgaaaaaaggcgcgagctcagacttttgagacggaagattcccgaacagcgcctcttctccctccggttcatcaaaccattggtgcctcttttcatttatatcggccgtattttcttcttttctcttttttaaggaaaattttttcctggccggcgcttgatcggtttccccgccggcagccgtttccgtttccgtttcttccgtcatccggtcaaacgcttcaagaagcgcctcccagcgttctttcttcagccggataaactggttcatataatggtatggatcaagttcatatctggatatgcagtcgtgaattttgatgatctgtgccatgtgatttctccactccgaatatttgtttatgtcaattgaaactgtgcgatttcttcgtatttaggcgaccggtcaagatgggtctgaaacagggaaaaccggctgacggcactttgcaccctgccgctttcaaacggcacatcgtcaggaaacggccggtctcccgcccacttccgcgccatcgtcatatgagggtgatacggccgtttttccacttgaaaaccggctttcaaaacagcctgttttgttttttcccgcaaatcaaagagcagttcattccgttcgggctcaaggtgaagcactctcggctgtctgcggtcgccgaaaatatccagatgctgaaactgtacggtaaacggctgcgctgccgacgcagcatctgcgagcagagacgataatttcgcaagccgttcttcatccgcggctccgagaaaaatgagtgtaatatgatagtcatgcgggtgcacccattttttgaatgataacgccggctcctttttggctgcttcccaaatcggttcagcaatgtcagccggaatcggaatgccgataaaataatgcggcaatgaagctttcatacgaggatctccccctctttggttatggtgttattataaaacggataagcggagaggagaaccctgtccgctcattatgataggatattatgtaccaacagttttatacagaaaggaatgagccggccttgaaaatcgcaaacagcacggcggagctgatcggcggcacaccgatcgtaaagctcaatcgccttcagccagaacatgcagcacaggtctatttaaaattagaatcgtttaacccgagcggcagtgtcaaagacagagcggcttacaatatgatcattgaagcggaaaacagcgggcatttaaaacccggctctgtcatcatcgaaccgacaagcggcaacacaggcatcggcctggcgatgaacgcggcggcgcgcggctacaaggcaatcctcgtcatgcctgacacgatgacgaaagaacgcatcaacctcctgaaagcgtacggcgcggaggttgtgttaacaccgggggcggaaagaatgcccggcagcatcaaaaaagcgaaagaactcgccgaacagattccgggaagttttatcccgatgcaattcgataacggcgcaaatccagatgcccaccgaaaaacgacagccattgaaatctatcaggccgttcagcagctcaacagaccgctcggtgcttttgtggcaacggcgggaacgggcggaaccattaccggaaccggagaaacgctgaaagagcttttcccggatatgattgttcatgtcgccgagcctgcgggatctcccgtcctgtctggcggaaaacccggcgctcataagcttgtcgggacaagccccggatttattcccggcatactgaatcaggacgtttacgatgaaatcatgaaaatatctgatgaagatgcgtatacgacaacacggcgtctggcccgggaagaaggcatactcgtcggcccgtcttcaggcgccgcctgctttgccgccattgaaaccgccaaacgcctcccttccgaacagatcgtcatctgtatgacggccgatacgggagaacgttatttatcaacggatttatggtcatttgaatgataaaaagggatgccgctttcggcgtccctttttattatcacttggcaagctcataaatggcttcggcatataaagccgttgacctgagaaggtcatcgatttcaatgtactcatccttttgatgcgcgctgtcaggccggccggggaacagcggcccgaacgcgacgcccgccgaaagggatctcgcatacgttcctccgccgattgaaatcagatccgctttctttcccgtttgtccttcgtaaaccttttgaagcgtctttacgagcggatgatcagcagaaacgtggtgcggtttgctgtctttaaattcttcaagccggaattcttcagcagacgtaaaagcatcacggatgactttgccgtctgaagtgacgggataacggatgttgatgccgagttctccttcctcaccctttctgtatgtaaaggtgccgacattcaatgtcagctctccgctgatgtcatccctgcaatcaattttcagctttttgcctcgtgtatcatttgaaaaatagtcactgatggttttgacaaagtgctttccggctccatccagctctgttccgttaaggcattcagcaagctttaagccggcattgacaccattatccggttccatcgcgtggcatgattttccgtacacccgaagcgtcagttttccattttccgaaactgcttcaccttgtgtttttgactgctcaagccatttgctgaaatacgcgtgcacggcatcaagaccgttcccttcaataaccgcttcagccgcatccggcaccatgttcaaacgcagtcctgaacggaatgacagaagcacgttttttgcgtctttgtcagaagcgctttttacaatgcgcagtgacgcatctataattcctttttccgcgttaatgatcggaaaatctgcgtcaggagcaaagccgatgtcaggcattttttcgtgtttgaagtagtgatccacgcatctccaatcactttcttcatccgttccgatgatgattctcacgcgtttggataaagggagctgcatgtctttgacgattttcagcgcataaaacgccgccattgtcggccctttatcatcaatggcgcctctggcatatatccggccatccctgatatcggctgaaaacggatcgctcgtccagccgtctccgggcggaacgacatcgacgtggcacaaaacgccgacgatttcgtcacccgttccccattcaatatggcccgcatagccgtcaagattctttacggtgaagccttcttttttaccgaattccagcagtgacgtcaggctggcattgacgccttctccaaacggccggccgggaccggctgttgattcgtccattacgctgttgatctgcaaaaacttctgcgtgtcacggatcagatcttctttgtttctgatgacttcaacttcccagttcatcacaaatcccctttcttgataaagacttgcaaaatgtcgataaaacgaataatatagatgatgttttgaaaaaatgttcgtcattggaggtacttatgtttcatctcgacaagcatcaaacgacaataaaaagagaaattaccgcgggattgaccacctttttcacaatggtgtatatcattgtcgtcaatccggtgatcctttccaatgcggggattccgtttgaccaggtattcaccgcgacgattatcgcttccattgtcggaactttatggatggctctcgctgcgaattttccgatcgccattgcccccggcatgggcttaaacgcgtatctcgcctttcacgttgtcggcacaggcagcggcattacgtatcagacggctttcagcgccgtttttatcgcgggagtcatctttattattttatcgttaacgcctttaagaaaacaacttatagaagcgattccggacaatttaaaatacggaattacgaccggcatcggcttatttatcgcttttatcggcttacgccaatccggaatcatcacggctgataaatccaatctggtcgcactcggcgatcttcattcgcccgccgtcattttaacgcttatcggacttatcatcagtatcgtgctgatggtgctgaatgtaaacggggctctgttcatcggaatggcgctgaccgccgtcattgcctttttgaccggacagatccattttgcgaaagggttcgtttcattcccgcgcctgccggaggggcttttgatcacaaatccgttcggagccctcggggatgtcgtgcatcacggtctgtacgccgttgtgttttcttttcttctcgttacgatttttgacacgaccggcaccatgatcggtgtcgccgaacaagcgggattgatcaaaaacaatcagctgccgaatgccagaagagcgctgttggctgattcgaccgctacgacggtcggaagcatcttcggcaccagcccgacgaccgcgttcgttgaatcttcagcaggtgtggccgccggcggaagaacgggtctgacggcgctgacgattgccgttatgtttgccgtttccatgtttttcagcccgcttgtcagcgtcttatcggaagtgtccgcgattacgtcaccggctctgattattgtcggcagcctgatgatgggtgctgtgtcgaatatccgctggaatgagcttgacgaagcgttcccggcctttctcgtcattttggcgatgcctttaacgtccagtatttcaaccggaatcgcactcggcttcatttcatatccgcttgttaaagcagctaagaaaaaatggcgcgaaatccatcctctagtcctcatcttcgccgtactgttttttattcagctttttattttgaacggacattaagaaaaatccctttccttttcggaaagggatttttacatataaagaacggaaagaatcgcggcaatgagacaccaggcggaacagatgatttgaatgacggttaatgcgctgtttcgcgcccggaaatagtcatcgctgtctctcttgataccgcttaaaaccggtttacccgtgatccggtcaaataaaagtgacgcggcatagcggctgacgatcgcaaataaaataaggactgccggcttcactaagagcggaagaacgagaataagagccgtaaaagccgcggttaaaaggtaaagctgccggagatacccgccgtttcggatcagcactttaaagaacaattctttccacgccgtatacgccgaccgttttgtaaagatgtgctttgagccgggatataaaaacggcttgttccgccctttatttttaccattcgggagctgcacatcatggctgagcatcaaaacagaggcggcgagtgaaagcttccgcctgttctcctcaagcacttcttcctcaaaggccgataatgtctccgtccctctccaagtcaaaagagcggaacagatgaacaatatacatcccgccggccaaagccaataccattcggcggcaaaggtgatcataaaaaacgcacccgccatcagaaccatcactttcagccagcccgccgcctgattcccgaatgtccgcctgctgttttttctgtgccggtgcaccgctaatatcgcggtatggaagccgaacagacagcaaaacatacctgaatatgccggtaaggtacagtcaccgtactggcgccataagggaaataataatacggcaagcgcaccccaattgataagggaaaggaacatcgaatacaaaagcgcgtaccgtttcagcttttgcatcagatgttttgcatgcaccaaaaacacgtgatccgcttccagcaaaaaggtatgaataaaacctgtgcataacagcagggcactgaatacatacagccagccccatcctaatactcctgcccctccattaagaagccccctgccgttcagccattcagcatattgataaacggcaaatgcggcagcgggaagaacgatatacagcgcgaccgtccaatcaatgaccgtctgaaacaccttccattgataccgccaataatgaaacagcctttgaaaaaacagagcccgcccggtcatcgctgactgctccgaaccgctgaataaaagcaatccagcagtgaacggctccccgttttttcctgaagctcctctaatgtgccttgaagaagcagagcgccctgatccagcaaataaaatcggtcgcagattttttccgccgtatccagaacatgcgtgcacatcaaaatccccgcgcccctttctttctcagcaatcagcatgtcggtaaacagctttgttgagatcggatcaagtccgataaaaggctcatcaatgatgtaaatatccggcttcgccaaaaatgcctgtataagcatcagcttttgctgcatcccttttgaaaaaccggaaggcaaatcatgttttacagacgtcagcgaaaactcttcaagcagccgccctgcccgctcacggcactcttccccttctataccccgcaatgacccggtcagctcgaggtgctcccaaagtgtcagttcatcgtaaaaactcggacgctccggtatgtaagcataagacgaatcattccactcaataccgccttcaatatcccgggacagcccgagaaccgcctttatcactgtacttttccccgcgccgttcgctccgattaaaccggcaatttcaccagcgttgactgacagagatacatcagaaatcaccttcggcctgtcagcataaccggcgcagacaatgtttgcattcaataattctcccaaacttctcactcccccgttttcatacggacatgtataaaaaaagtttcagtttccataataataaaagcgggccggacatagtaatgcaccaaggctgtacccatttgaaaaaattacctgcgcttattcctagattcatgtcgtccatatcgtgtataatggaggcagttaaaagagaaaaaacagaatgtcatcctttgttgcttattcgtacgaagttttagagtcgaaagttgtggtatatcaagtccatccgatcttatgatagggagtggttttttgaaaccttcaacaaatcgtatgctgactcggattaaatcagtttacatgttcatccaggaaaaaggccttgtgacaacacaggaactggttgatgaattcggcattacacctagaaccattcagcgagacttaaatgtgttagcatacaatgatcttgttcatagtcctagccgaggcaagtgggagacaacacgaaaaaaagtgaaaattacatcttaagcgaacaattacataaggcccttttcggcctgacatgctgcaaggcaaagcagcgtctttgccttgttttttgttcctctatataaaaagcccaaaacaaatctgttttgggcttttctgatatcgattacacttctgcgcctctcagcgtttcgagctcctcttcagtcagctcgcggaattctcccggtttaagatccgggtcaagagaaacagcccccatcgaaagccgcttcaaataagccacttcatttccgacagcctttgccatcagcttcacctgatgatatttgccttctgtaatggtcaagtgtatcaccgtttcatccgggctttctgtaataatttcaacggctgccggcttcgtcttatagcctccttcaatgacgacgcctctttccagatgaacgatgtcttccggtgacagaggtgaagttaaccggacctcatatgttttaggcacatgctttttcggagaaaggaggcgatgagcgagctgcccgtcattggtgagaagcaaaaagccttccgtatccttatcaagacgtcccgccggaaacggttcaaatcgctgttcttcaggcgtcagcagatcaaccaccgtttgctggcggctgtcttctgtagcagacagcactccttgcggcttattcatcatgacataaataaattcacgatagtctgccggctctccgtataccgtgatgtcctgtttttccggatcgacatgggttttcacatctttcgccggctctccgtcaatcatgacagccccggccttgacgatttttttcacatcttttcttgagccgaatccgctgttggcaagcagcttatcaagtctcatcctgatcctctcctttaaaaagaaaagcccgcgataagcggactattcattatttctcaatgggcggaatgcctgcctcttctcaaaacgcggggcagacggtttccaaacattttctgtaaaaatccgattcggtatgcggcaaacatgtacaccgcaccgccgacagcggcgcagacaaagacgacaatcgccgcatgcacctggccgctttggtatgttacaaagaagctgagcagccattgagtcatcttgaccgcgactcccatcacgacggacaggactgcgattaaaatgacccgttttataagtaccgtatacgaatagcccgcatggcgcttaatcatgacaaaaccgtacagaagagaagcgatataaccgagcgccgttgccaagatggccccgtctccctgaaacagcttgatcagcggcacgttcagcaccactttgataatgacgccgatgaaaaggctcacgacagcaaatttctgcttattaatcccttgcaggatcgcggcgtttacggtaaacagagaaaacagaatcgcgacaggcgcgtaccagaacaatatatcctgtccgatatccgggcgaagactttcagagccgtagaagaatgtataggccggacccgataacacggacatcccgacaacagcgggaataaccaaaaacagaatgatttgcatcgtctggttaatctgctggtttaaaagcttataattcctgctcgtaaacgattcagtaatcgtcggaatcagcgtcagaccgaaagcggtcgccagagaaaccgggatcatcacaagcttcggcacataaagggtgacaatcgcaagcatgtcctggctgatatccttatggcccgccgcaatcatcgctttattaaacgtattcgtatcgatatacgaatacaaaggaatcgccagtccgacaaatacataaggagcggcataactgaaaagctcaatgaacatttttttataacttaagttcgcagacgggacgagattcggcttcatcgccagaagatcgcccttccgcttattccagtaaatataaaggacgacaagccctccgaatgatccgatcagcgccgcaaaagtcgcgtatccgactgcgatgacaaggccgccgttgatcactcttaaaatcaaatacgttgcgcccaataaaaagatgatccgggcaagctgctccacaacctgtgaaacggctgtcggccccatcatctgatgaccttggaaaaaaccgcgcacaagactcataatcggcacgaccaaaagtgccagactgaccatccggatcacataaacgacgtggtcaatcgtaagtccgttgttactcgtgccgccgagagatgtttccgcaaaaaacggcgccgaaatataaagaattgaaaaagcgatcatcccggttacgagcataaccgacattcccgctctcagcatccgcctgctcgtctcatagtctcctttggagttatatttcgagacaaattttgaaaccgcggcgggaaatcccatcgtggcaatgtttaaaaacagtgtatattgattatatccgtattgaaacaaagctccgcccgtcgctccgaccatcgctccgaacgggatcagataaatcatccctaaaatccgcgatatataggtgccgagcgtcagcacgaacgtgccccttaacaatttgcttgacatgtttcctcatcaccattttctacgaagattcaacttttctattttaacacaactgggcaattagacggtaataaatacagcgggaaactttttgggaaagctcttaaaaaaacaaaatacgtttaaggaatccctttctttcgctataatagcagaaagcggacatttccgcctattatacgtgaaaaagaaagttgttgatgaaatatgaaacattatgacgtcattgtgatcggcggcggtccgtccggtttaatggctgcgattgccgcaggcgaagaaggggcggacgtattattaatcgataaaggaaacaagctgggacggaagctggcgatttccggcggcgggcgctgcaacgtgaccaaccgcctccccgttgaagaaatcatcaaacacatccccggcaacggccgctttttatacagcgcgttttccgaatttaataatgaagatatcatcgccttttttgaaaaactcggcattcagctgaaagaagaagaccacgggcgcatgttcccggtgacggacaaagcgcaaagcgttgtcgatgcgcttttgaaccgattaaaacaactgaatgtcaccatccgcacaaatgaaaaaatcaaagaggtgcggtacgagaacggcaggacagcgggcattacgacaaacaatgacgaacacattaacgcagacgccgtcattatcgcggtcggcggaaaatcagtcccgcataccggcagcaccggagacggctatgcatgggcggaagcggccggtcataccgtgaccgaactctttccgacggaagtgccggttacgtcgtcagaaccgtttattaaacaaaaaacacttcaggggctgtcccttagaaacgcggccgtcagcgtcctgaataaaaaaggcaaacctattgtcacacacgtgatggacatgctgtttacccatttcggcttgtcaggccccgccattctccgctgcagccagtttgtcgtcaaagaactgaaaaagcagcccgatgtcaaattacgcatcgatctgtttcccggcatcaacgaggaagagttatttcaaaagatgcacaaggaactgaaagacgcaccgaaaaaagcgctcaaaaacgcgctgaagccgtggatgcaggaacggtatctgctttttcttctggaacggaacggtcttgatccgcagacaagctttacggaactgccgaaggatcaattcagggcttttgtcaaagactgcaaacaatttacggttgccgctgacggaacgctttctttggacaaagcgtttgtcacaggcggaggtgtttccgtaaaagagattgagccgaaacaaatggcgtctaaaaaaatggaaggcttatatttttgcggagaaatactcgacattcacggctataccgggggctacaatatcacttcagcctttgtcacggggcgtctcgccggtttgaatgcaggacgtttctcacgctcgctgtaaatggtttaaagcgcatttacctgagcgtccccgttgataattgaccaaaagcatgatacagttttctgcgttttgtttcacctgattgagggaacaggaagaaaggaatgatctgcaatcgtgcgaccatactaaaaagtggcgtattgaaaaaaatagtcagagggtgagaacgtttgaagaagaacatctccagtgttttttggattgtgattgtcatcacagccgctgcggttttatggggggccatttctcctgacagcctgcagcaagtcactgatacggcacaaaaatttattacggattctttcggctggtattatctgctggtcgtttctatatttgtcggtttctgtctctttctcattgtgagtccgatcggcacaataaaactcggaaaacccggggaaaaaccggaattcggcttattatcatggtttgccatgcttttcagcgcgggcatgggaatcggtttggtattttacggggctgcggaaccgatcagccattacgccatcagctctccctcaggtgaaacagaaacaccccaagcatttcgtgatgcgctccggtacacgtttttccactgggggctgcacgcttgggccatctatgcggtcgtcgctttatgtatcgcttattttcaattcagaaaagacgcgcccggtttgatcagcagcacactgacaccgcttttgggcgataaagtaaacggcccgatcggcaaagcaattgactgtatcgcggtgtttgcgaccgttgtcggtgtggcgacaagcttagggctcggagcgactcagatcaacggcggtctgcattatttattcggcattccgaaaacattttccattcagctgatcctgatcgctgtcgtgaccgtgttatttttgatttctgcgtggagcggaatcggcaaagggattaaatatttaagcaataccaacatggcgctcgcggctattttaatgatctttatgctcattgcaggcccgacggtgctgattatgaactcatttaccgattctatcggccaatacatccaaaatatcgtgcagatgagctttcgcttgtctccgaatgatccccaaaaacgcgaatggattaacagctggaccattttctattgggcctggtggatatcctggtcgccgtttgtcggcattttcatcgcccgtgtatcaaggggccggacgatccgggaatttttaatcggggtgttggtgacaccttgtatattggctttcttatggtttgcgattttcggtgtatccgcgatggatcttcagcagaaaggcgtattcaatgtcgcgggaatgtcaacggatacgatgctgttcggcgcactcagccactatccgctgacaatggtgacatccgtattaacgcttgttctgatcgctgtattctttattacatcagcggattcagcgacatttgtgcttggaatgcaaacgtcttacggctctttggacccgtccaaccgggtgaaaatcatctggggcgtcatccagtccgccgtggcagctgtattattatattccggcggtctggccgcactgcaaaacacggccattctcgccgcggttccgttttcagtcgtgatccttctgatgatcgtgtctctgtacaagtcattagcgagcgaaagaaaaggaatcaaacaagcggagaaataccaaaaaccgagaagtccccgcgtcaaaaaagcataatgcataaaaaagcccggtatttcatccgggcttttttattttcggtataaaatgagagcggaaaaacaataaagctgctcaccttcaggatcacaggccgccgctaccgtatatttaatatcaacgagctgttcatcagaaatcccctttaaaaatgtattgacttcagtctgcagatccttttcatgctcctcatcaaaaacagctatcttcagcacatcaccctctcctttctctatcaatttattccggttcaattgaaatatgatagagaaaaacagattttcttttttactgatttttactaaaagtaaccaaaaatagtagttgaaaacgcttactaacgtatgataatatcattttaacaataaccaggtcatttctgtttagtaaatatttagtaaaaaggagatgcgaaatggtccgtctcaaagatattgccttacaggcatctgtatccagcgcgacagtatcgagaattttgaataaggatgactctttggccgtgactgatgaaacaagagaaaaagttctgaggatcgccgatgagctgggctatcagccgtcggcaaaaaaacggaagaaccgcagccgcagcgattcagcgcccctgatcggcgttgtcagctgcctgtcaccggaagaagaacggcaggatccttatttttcagcgatccgaaaaggcattgaggaagaatgctttcggcaaaaagtttttatcacatcttctatccatctcggttcttttcaagagcatatgtttcacgaactggacggcgtgatcgtaatcggcagcctgcaagacgaggcgcttacgaatatcagcgccgctttcaggcacgcggtatttgttaacggcacccccgatcccgcccgctacgattccgtcagcgtggatttttatgccgcagcgcagaaggcgatagaacatcttctgtcgctcggttaccagcggctcggttatatcggcggccgggagcgggagcataccgtcatagacggtgtaaacagcaataaaacgattgaggataagcgtctgaccgctttcttacaaatggccggcgccgggccggagcatgtactgatcggcgaatacagcatgcacgaagggttccggctgatgaatgaagccatcaaaggcggaagtctccccgatgccttttttatcgcaagtgattcgatggctgtcggcgctttaaaagccttgcaggaagccggccttcaagtcccgcgcgatacggcaattgtcagcttcaacggaattgatgaggcagaatacgccagcacgccgttatcaacggtaaaagtatacacggaagagatgggccggacgggtgtcaaattgcttctcgaccgtttaaacggcagaaccgtcccgctggccgtgacgctccccacttcattgattgtcagacaaagctgcggctcacaagaaaggaggtgacatgtcccgcagcgtttatatcatatttaaaggaggaaaagatgaaacgcttactggctttgtttctttcttttacttgcatgatacttcccggctgctcggcagaacggagcggcgccggagaaaagcagaaaacattgacagtctattccacaatatcctcagacagcgaacgcgccgtattcagaaagttggctgattcattccaaaaagaacatccggacattcaagtaaacgttcatttcccaggcaatgactacgaaaatatgatgagggtcagaatggcggccggtgacatgcccgatcttttcgacacacacggctgggccaaaatccgctacggagaatataccgccgacctcagcggcatgtcttggacgaagcggctcgatccgaatttaaacagcatgctcaaagacgccaaaggcagaatatacgccttccctctgaatcaggcaaaggacggactggcctacaaccgcacaatgttggaaaaatacagaatcaaaccgccggaaacaatggatgattttatgaaggcactgagacagattaaagaaaaaagcggcggaacagtcacccccttctggtttgccggctatgagaaaagctcatttgcccaatattacgatcaattcgccgcaccgcttctcatcacagatcccgcacaccgtttcaaaaaacagctgttaaacggaaccttccgctggacacacttcacctatttatctgacaaactgaaagagatgcaaaaggaaaacctgctcaatatagatgccgtgacggcaaaacggtcccagctcattgaactgatggcgcaaaacaaaatcgcctttacgctgcagggcggcaccctcggccaagacgtcgctcaaatcaatcctaaggtaaaagtcggcatcataccgaccccggccgtccacaagggagacgcgccggtttggatcggaggcgaacgttacacgctggcggcattcaaggattccccgcggcttgaagaagcgaaacagttcatcgcatttatggcccgtcccgagcatgcgaaatcaattgccgaagcgacctcgcttccggccggattagtgaatgtgcaaacggacattttctacgcaaatgactataagcgctatcagcatattaaggtgcagccttattttgaccgcctttatttgccgaacggaatgtgggatgtgatggggacagccgggcaggagctgatggccgatatcttaacccccgcggaaatttcggcgaaactcggcagggaatataagcggctccgtcttcaatctgattcacaaggagctgaaaaagaatgagtgatcttgcaagagaaccccaaggatttcaacatcaaaagccggtaaaacccgcgtcactgtggtggatgtacgttcccgctcttgccacggtttttattttcatgatttttccgtttgtcaaaggcgcttttatcacatttacaaactggaacggcttctcacagacgtatcaatgggtgggggtcactcaatataaaaggctttttacagatccggacacgtggcttgttgtgaaaaacactttgctttacggcatcggaagcactttttttcagaatatgctcggacttttatatgcgctgcttttgaatcagagcttaaaaatgaaggcgctcacaagaacgatcgtctacctgcccgtcattatcagtccgctgattatgggatacatttggtattttattttctcatatgacgggggtgcgctgaatgatgtacttggcgcactgggaatcggtcctgtcaacgccttggcaagccctgcggcaaacccttggattatcgtcatgattaacacgtatcaatacgcaggcattgcgatgattgtatatttggcggggctgcaaagcattccgaaagattattacgaagccgcaaaaatggatggcgcgggaggtcttcagccgtttttcaccatcaccctgccattattgatgccggctgtcaccatcaacatggtcatcaatatcatcggagggctgaagctgtttgatgtcattttcgcgctgaccgcaggcgggccgggcaattcctctcaatcgatgtcgacgtttatgtatgatttatattttaaacggcaggatgcgggatatgccgccgcccaaggcgtgtttatgtccgttattattcttgtcatcagcttttcggctctcgtgtatttcaagcgaaaggagacggaaatgtcatgaaaacagcccgaatgcggatctttacgctgttggctgccgttatctcgtgcgttcatattgtccccttttatattttgctgaccacgtcattaaaagcaaaaggagactacagttcaaaatggtcgctgccatccgccttttcatttcagaattttcgtgaagcatgggagcgcgcctctctcgggcaatcctttctgaacacgatcatcattacagccgtttccgccgccttgctaatttttatgggttcgcttgccgcatacccgctcgcaagaagaaatacaaagctgaacaaaatcgtcttcggccttttgatttcaatcatgatcatcccgcctttgacttccatggttcctttatacaagatggtcgctgatgcggggctggtcaatacgcatgccgcagccattctcattaatacggctgcatatatgccgctgaccgttttcttatattcagggtttatccgctcctctattccgaaagaacttgaggaagccgccaggatggacggcgcgggattgatcaggactttttatacgatcgtgtttcctttgttgaaaccgattaccgcaacggtctgcattatttcctgcgtgtttatctggaacgattaccaatttgcgattttctttttacaagatcaaaaggtgcagacattgaccgtggccatggcgggattcttcggcgaaaacgcgaacaatcttcacttagtcgccgcagccgcaattatggcgatgctgccgatggtcgtattgtttttggcgcttcaaaaatattttatctcagggctgtcctccggggcggtcaaaggctgagaagaaaagggaggaatttctgttgaagaaaattacgtttatcggagcgggaagcacgattttcgcaaaaaatgtactgggggactgcttactgactgaagcattaaacggatttgaattcgcgctttatgatattgacgctgtacggctgaaagaatcccagctcatgctggaaaacatgagggaccgctacaatacgagtatatccatcatctcttacgatgaccgaaaacaggcgcttacacaggccagatatgtgataaacgccattcaggtcggaggctataaacccgcgacggtcattgactttgacatcccgaaacggtacggtctccgccagacgattgccgataccgtcggaataggcggcattttccgttcccttcgcaccatccccgttttatttgacatcgcaaaagacatggaagaggtctgcccggatgcgtggctgttaaactatacaaatccgatggcctctctgaccggagcgatgctcagacatacaaatgtcaaaacggtcggcctgtgccacagcgtccaggtctgtaccaaagatctgttcgactcactcggcatggatcacgaaggtacggaagaacgcattgccggcatcaaccatatggcttggcttttggagattaaaaaagacggaattgatttatatccggaaattaaaagacgggcacgcgaaaaacaaaagacgaaacataaggacatggtgcggtttgagctgatggataaattcggctgctacgtgacggaatcatctgagcataatgccgaatatcacccgtattttataaaaagccggtatccggagctgatagatgaactccaaattccgcttgatgaatatccgaggagatgcgcggatcaaatcaaaaattgggaaacgatgagagacggcatcatcaacaaccaaaacctgacgcatgaacgctcgaaagaatacggttcgagaattatagaagcgatggagacgggccgtccgttcacattcggcggcaatgtgctgaataccgggctgataccgaatctgccggcgaaagcggtcgttgaagtgccgtgcgccgccgccaaaaaccaaattatgccgtgctattccggcgaacttccggagcagctcgcggcgctcaacagaacaaacattaacacacagcttttaaccatcgaagcagccgttacattaaaaaaggaagccgtatatcaagcggccatgcttgatccgcatacgtgcgccgagctttccatgaatgacatcatctctttgtgcgatgacttatttgaagcgcacaaagaccggcttccggcttatcattgatcattcgcgatccggtcctgagcgggccggacgcttttatatgttcagcaccagtttgaccgtctgtaaggtgtgtcctttaaaatcttcttcaaattcacataccctttgaaaccctttcgcttgataaaaggacaaggcgatgcggttctctttttctgcatggacataaagcttttttaccccgccggactgcctgatgcattctttaagaagtgccgtgcctatcccgcttccctggcaatccgggtcaatatagatggcggtcagctccgcatttccgtctttttgaaccggggtgacatttgcaaaaccgagcactcgcccctcttcttctgccacaaagaacaaagaatgcaagagccggcgttccatcatcccatcctgataggcggattcgagaaactgatcctgaatgtgtctgggaataatcccttcatatgtatgatgccagcttcgttctgcgacttgccggacctgtttgatatcgtttgttttcatcgcgcggatcatcggtttcacctgattcgcctcccgtttttttataaaaaaagaagaaaaagacgcacgtcccttttcttctttcacttcaaagcgttatttcttcggctttgtttcgccttcccactccagcatgccgccttcaacattaactgtacggaagccctgctcatgtaaatacatacaaacgttcatgcttctttttccggaacggcagataaatacatattccttgtccttgtctaacgcatccatcttctcagggatgtcccccatgcggatatgaacggcctccggaatcattccttcggcaacttcttcatcttctctgacatcaatcagatacagctcttctcccgcttttaatttttcttccagtgcggctgtgctgatttcatttattttcaatgcgtgacactcccattcatctttatggtgttaagtataccaaagcccgcggtgcaatttctatgatagaggcctgataaaaaagcccctctctgtaagagaggggcttcgtccggtcagtttgccacgatattgacaagcttgcctggtacggcaatgatttttcggatcgtttttccttcaagctgctcttttactttttcgtcagcttgtgcgagctgttctaacgctgctttatcagcatcagccggaaccattaatttcgcttttacttttccgttcagctggacgacgatttccacttcatcgtccaccagttttgattcatcataagcaggccaagcctcgtatgcaatcgaaccttcgtggccgagtttttcccacagttcttccgccaaatgcggcgcaacaggagaaagcagcttcacaaaaccttcgatatattctctcggcagttcattcgctttgtaagcttcattaatgaagaccatcagctgagaaatgcccgtgttaaaacgaagggcttcgaagttttctgtcactttcataaccgtttcatgatagacgcgctcaagagtttcgcccgcgccttctgtcactttacccgtcagctcgccgttttcctcgataaacaaacgccatacgcggtcaaggaagcggcgcgctccgtcaagacctgattcagaccaggcgatagatgcgtcaagcggccccataaacatttcgtacaggcgaagcgtatctgctccgtgagacgccacaatttcatccggattgacgacgtttccgcgggatttactcattttttcattgttttccccgagaatcatcccttggttatacagcttttggaacggttctttcgtcggcacgacaccgatatcatagaggaatttatgccagaaacgagcgtacagaaggtgaagcacggcatgctccgctcctccgatgtaaatatcgacgggcagccatttatccaatttctcaggtgaagcgagctgatccggatttttcgggtcgataaagcggaggaaataccagcagcttcccgcccattgcggcatcgtgttcgtttctcttctgccttttctgcccgtttcaggatcagtgacttccacccactctttaatgttggcaagcggtgattcacctgttccgctcggtttgatctcatcggttttcggcagaatcagcggcagctcttccgccggaacggctgttgacgtgccgtcttcccaatgaatgaccggaatcggctcgccccaatagcgctggcggctgaacagccaatcacgcagacggtatgtcacttttttctcaccgtttttcgtttcttcaagccaggcgatcattttttcaatcgcttccgctttattcagtccgttcagaaagccggaattgacatgttctccgtctcccgtgtacgcttcctcttccgtgtttccgccttttacgacttctttgacaggcaggctgaacactttggcgaattcaaaatcacgttcgtcatgcgccggcacggccattacagcgcccgttccgtaagaggcgaggacataatccgctatccagatcggcagcttttccccgtttgcagggtttacggcatatgcgcctgtgaagacgcccgtttttgttttcgcaagatctgtccgttccaggtcacttttcgcctgaacttctttaacataagcgtctaccgcttctttttgttcaggtgtcgtgatggcctccacaagctcatgctcaggagccagtacggcataagccgcgccgaacagcgtatccggtcttgtcgtaaaaaccgtaaacgtgtcatcagtgccgtcgatcgcgaaatgcacgtttgcgccttctgagcgtccgatccagttgcgctgcatgtctttaatgctttccggccagtcaagttcttctaaatcttcaagaagcctgtccgcataagcggtgattttcagcatccattgtctcatcgggcggcgttcaaccggatggccgccccgctcgcttttgccgtcaatgacttcttcgttcgcaagcaccgttccgagcgccgggcaccagttgaccggcacttcgtctacgtatgcgagccctttttcgtacagcttggtgaagatccattgcgtccacttgtaatagtccggatcagtcgtattgatttcacgatcccaatcataagaaaatccgagtgattggatctggcggcggaaattatctatattttgttttgtgaactcagccggatcatttcccgtgtcaagcgcgtattgctcggcaggaagcccgaacgcgtcccatcccatcggatgaagcacattgtacccttgcatgcgtctcatgcgagaaaggatatcggttgccgtatagccttccggatgtccgacatgaaggccggctcctgaaggatacggaaacatgtcaagcgcgtaaaacttcggcttgtcattctcttcactgacggcgaacgttttatgatccaaccagtaattctgccatttcttttctattttttcgtgctgaaaactcaacgtaaaaacctccttctgattgaatacggcgtatgtagtccaagtattgacgggatgaggaagattatattcagattattctaaaactaaaaaaaactccctcatccctaaaagggacgagagatttttgtttcccgcggtaccaccctcgttagcgcggttttaagccgcactcacttgatacttttaacgcagttatgcgtcagcggttttgccgctgcaactctgaggcgagttcggaaacagacttgattgacttgcaccggccgtcaactctctgagtgcgaaatctgcttcttactgctcctcttcactgttcttatcgctaccgtaatcttacctgtattttatagaattctgttcataagtgcaagcaggtttgtatacaatgggaatgtacccggaacgggtcgtgagcggggatattattttgatggaggatttttttgctggtgtggttttgcttcggccgaatcactgttttgttctctgacaaaatcaaagctcctgagaacagcttctccgccgtagcctgcgattatggataagatgacgagttgaattcctgaatcggggtcagcggataagacaagtaagatggaagcagccattccgataaaaccatcttccaaaaaaccgagataaataaaccgctttgtcattctgggtttctccagcctgcctctctttttcacatgaccgagaacccccatgatgcctccaattacacaagcaattattacctgatgcagcatcttcatcaccttcctaaagcccttatttagtaaagcgacttcaggccatccagcccccttacgaatacgatgattttcgatatctacataccggcgattgaacaggaatgtaaaaagcttgtttcttccattatatgtgaacacatgatcggtaagcttgatgcattagattcatttttcacccagtgacaatgacctagtcacttacttagcgatgatgtgccttccccttatatattcagtgtatatgaggacaagcccgaatgacaaattgcaaacttcggctgcttgaatcagaacatatgttatgctacggttactgtagattcatttaaaaaggggagaaacaacggctgaaaaaagcgcgcagctttacggccaaaagggggttttacatggctgactcaaatgtatccggaaaactggagcagctggagcttatcaaaaaggcgcttgatcacgcacgcatcggcgtggtgattacagacccctctcttgaggacaatcccatcatatatacaaatcagggatttatggatatgacaggctactcttccgaagagatattaggtaagaactgcagatttctgcaaagcaaagaaaccgaccgtcaacaagtcgcgaaaataagaaagagcttaaaccagaaagaaaagatcacggtgcggctgaaaaatatcaaaaaagacggcaccccgttttggaatgaactcaacattgatcctctgtatgttgaagacaagctctattttgtcggttttcaaaaagacattacagagcagaaagaatacgaaaagctccttgaggattccctcacagaaatcacgacgctttcaacaccgattgttccgatccgaaacggcatctccgccttgccgttagtgggaaacttaacggaagaacgatttgattcaattgtgacaactttgacggacatattaaccgcatctaaagatgattacttaattatagacttatcaggtttggccgaggtaaacgaacagaccgcagaccggattttcaaattgcaccacctgcttaaattaatcggcacagaactgattatcacgggtatcaagccttccctcgccatgagaatgaatcagcttgatgccagcttttcttcattaaagacatatttaaacgttaaggacgccgtcaacgtgcttccggtcgtataaacaaaaaaatcccgccgaaacagcgggatttttttatgtcgtcatcgcacttggacgttttgtttattaacggttttcaggcgtttgtcgtacagcaccgtcgctgcgatgctgacaacaagaagcaccatcaggatcaacagcagcacgctcatgccgtactgatcaaccagcacaccgccaaggagcggcccgatcattctgccgcccgtcgccgcactgttgacgaatccttggtaaaacccttctttccccttaggcgcaagctgattggcaatggtaggaacggcaggccagacaagcatttctccgacggttaaaatcaccattgcggtgaggtacatcggaaattgcctggcgctaagaagcacaccgaacgagacgataaaaatacaaaagccgatgaccatctgcgtttttaacgcaccggaccattttttcagaacagctcctatgagaggctgtccggcgacaattaatattccgtttacggtccagagcacactgtataatgaaagcggcataccgatgctttgagtatgtgacgcaacggttgtggaccactgcgaataggcaatccacccgagaacatacccgccgctcaatatgagaagcgccgtaaatttcgttctgctgctgacaggctcgtagtccagaacagaaacctggctcgcatttccggttttgatatttcgaaacccgaaaaatacgataaggaaaaacagcacatacagcaaagcattggctaaaaacacgtacgtaaacgagtacgccgcaaccatcccgccgagtgccgagcccacggcgacacctgcgttctgagctacataaatcgcattaaaagctctccgcccgccttctttccataccgctcccgccatggcgtaactggccggaaacacgataccggaaccgaagccgacaatgatgagcagccaaatataaacgggccattggtgaaacagaacgagtccgagaagacttgccaatgtgatcataatgcccagcataatggatttgaatccgccgattttatcaaacaaaaatccgccgcataaattccccgccacactggccccggaattcagcatcagaacaatccccgcaacagtcagcgatttccctaaatgattatgaatatagatcgtattcagcggccacaaaaaagatgcgcccgtcacattgataaacattccgatgattaatatcttcaaagcgcgcggcataccgatccccctctctctataaaaaaccccatgaaaaaacggaaaccgcaagccgcggctccgtatcgatcacgttatcatagcacattcattctatcgccgcggacgtcttttttcaacatcagaatctgaaaaaaataatgccggaatgttgaaaaaattacaaatgattggattcgcaaaaacagaccggcttcatgctcttttcctcagcagccaaaacggaatatacagaatgaaaaagctcaatatcaccgccgcttccattgatagaagataccacggccaaggtccgaaaacattcagaagcgaagcggtcttcggttttttcattaaatataggtaatttgcattcagcacacgatcaataaaaaagacacacgccccgtacagatttacgatcagcaccgacacccacagcccgcgcgcagacggtctgtacttttctgcagcggccatgaatagacaggtaagaaaaacacagccgtgggagacgaaaaacacgatgtaccgaaaatgcgggaaagaatacgcccctaaatcaggtgttgccatcgcctgtacggcgctgcccaaaccggcaaaatagaggaaggcgaacagctttttgctttttgtcataaccatcagcatcgccaaatagacggaaaggtcgctcagctgcagcggcagagctgttttcagcgaccaggcatgatgacaaagcagccgtatatgatagctgatctgcgacacggcaaggagaatgaatagtacatagcggatcatgcgactctggttgagctttttccggaatacgatcacgcccgcccccagcaatccgatgatcaacagcgtgaaaatgtgttccttggaaaaaagatgaaaggcccctgtttcagatttcaattgaaaatacttctgcataaggctcccccgcgcgaaaaaatgacgtatgtctattcttttaaaaatcgctttcttctattcatacaaaaaaagcctccgcttatgcggaggctcctcaacttgttttacaaggcggattgaatgacctttttataatacagcaccgacagcatgccgaagatggagtacagcagcgtatacagcgccatgacgatgatcatcggcgtccacacttccgttccgaataaaaaccatcctgattgaacggcaaaatagctgtggaacagcccgagaacgagcggaatgccgaaatgatacgcctgcttccggcggatgcctttcagcagatctcccgttgtgaagccgagcttccgcaatatcgtataatcagccttctcatcctcacactcgcccatttgtttaaaataaaggatacagcctgaggtgatcagaaaggttaatcctaaaaagccgacaataaacatgatcagccccatgtttttcttttgcgtgtcagccgtttcaaattgtgaaagcgcgccgtctgaatagtgctgcgcctgaaacagaccatcagctttttggatgtcctcttctcgtttgagtgtaatgccgaaaaaccgatttgattttccctggatggacgggtcgatatctttctcgatccggtcgaatacctgctgcgtgacgataacggtcggcagccctccgcttgtaaatgtatatgacaggaggaagtcgttcttcaagcccttatacgccagcggtattttatccgttttgccgtttatatcaatggaacctgacgttttcaggtcgagaaatcttttcatcatatcattatatccggtaaacacggcttctccgtcagaaagctccgtcccttctgcgtctttctcgcttataatcggcagcgccaggctggacgggtcttgttgaaagcttttcatgtcgccgtttatgatgttcttcatattgacaccggcttgaatggtcttgattgtttttactttgtgttcaattccgtttttcttcaataaagcggtaaatgagtcagtctccttttggttatcaaacgcaaagtccgcggctgtattttgctcagccgatttttccgcggagtagtacgagatatagcttaaagacagtaaaccgattgccagcgccgaaagagtcgtaataatcgtcagcaatacggcgtttgacttcatccggaacatgatggatgacaaagacagcacttcactgacattcagatacccgccttttgatttccggatgagatttgccagaaagctgaccgaacctttataaaacagataggttccgataatgaccgagcctagaataaacaccatggccgaaaacagttcattcatgctcgtaaaactgcctccgaataaatccgcggacacggcatagccggcgataatggccgcaataccgacaacgccgatcaacatctgcacccaagaaagccgtcttatgccgctttctgacgatgacgcggttttaaataaagacaaaatgctttgccgtttaataaataagtaattcatcatcataatcagcacgtaaattgccccgaacacaattaacgtctgaacgagcgccttgctagaaaaaaacagtgagacagaggctttcacatcgactgtatgaaacagcatcatcatacataatttcgagagggaaaagccggcaaaaataccgatccaaatcgatccgaaatacaaaatgaaattttctgcgctgagtatgcggaaaatgtgcattttcgtcatgccgattaatcggaataagccgatttcccggccgcgccgtttaataaaaatggtgttggcgtataaaagaaataccgacacgatcgccacaagcagtacagaggcggcccggattgccgccgctccttttatggagcttttcatttcatcaagcgcaggatcgtattgcatcgtgacaaacgcgaaataaagggcggcgctgaacaccagcgcaaaaacgtaaaggtaatagtttttcatattctttttcaggttctggaagatcaaatgatgaatactcatgcctgaaccccgcccaatacactttgcgttttcataatatcctgaaaaaagtccggtctgtcctggccgcctttattcagctgtgtatacacacggccgtctttaatgaaaaccacacgtccggaatagctggcggcaaccggatcatgcgtcaccatcacaatggtggcgcggcgtttttgattcaggcggctgagtttattcaataaatccgtggcagcctttgaatcgagcgctccggtcggctcatcagcaaaaataatgcccggctcgtgaataacagctcttgcggcagacgtccgctgtttttgcccgccggaaatttcactcggatacttatgtctcaaatcatagatcccaagctcctctgccgtctcggcaaatcgcaggtccgcctctttcttagacattttcgtaatggataacggaaggagtatgttttccttcacggtcagcgtgtccaataaattataatcctgaaaaataaagccgagatgccgttttctaaattcggcaagctgtttttctttcatggatgtaatctccgtctcgttcagtttaatggtgcccgcgctcactttatcaatggaggaaagcacattcaaaagggtcgttttccctgatcctgacgggcccataatgctgacgaattcccctttgtgaatctgaagatcaattcctttcagcacctcttgtttattcagcttgtttccgtagcttttttggatattgcctgcttctaaaatcatcacgttatgagtctccttttacattggttatctttattttaaaaacagaagccgtttttttcgtttgattaagcgaacaaaagagaaaagcatgtgacacttttgtcacacgctgaacatgctgacggcatcgttctgtttcggaaacaccaaggtaaaaaccgtgccgctttccggctcagagcgcacgctgatttggatgagaagaggagccgcggctttttgagccaaatacaggcccatccccgttgacgcgtgatctcgcctcattcgcgtcgaggtaaatcctttttcaaaaatgcgcggaagatctttgggctcgatgccgatgccgcggtcttcaatatcgacatgcacccggccgttttgttcatagctttttacggtaatgtcatccgcttcactgtatttgacggcattgcttaacagctgcctgatgatgaaggaaagccattttccgtcactgtgaacgtccggtgaatcaagctgaatgtcaaacccgatccctttttgtatgcaccatgattgcagatttttaatttctttgaaaacgagcggtctgagctgaatgcgctggaatgataaatcattttcaataaaggacaatcgtttctgatgaagctgctggtccaggagatggtgaatccgcagccattcatacagcaaaggggctttcagcggctgttcatcaaggcgctcgatcatgagatgcatcgctgtcagcggtgttttgacctcgtgaatccatgacatcaggtcatccttttcatgctctgacgccgcctgaagatcaagtgagctttttcgtaattgctctgtctgcccttcaatgctttcttcaacgatagactcaaacggactgtcaggcgctttaagataagacatgtctaaattggcgtcccactctcttaagcttttataataggcggtctctttccgatagcggaacaagagaaatacaagaaacacaagaagcgacaggtaaacaacatacagcactgaaagaaacggaatagacggatcaatatatgccgcaaaaaggagcacagcctgctgcaaaagaaacatcgcgatccagctttttctttcgagcagaaatgatttaatcataaagaccgtcttcttcctttgcgatgtatccctgcccgaccttggtttcaatcattttcccgatgcctaattgatcgagttttttccgcagccggttgacattcaccgtcagcgtattatcactgacgaaacgctcatcattccataggcttctgatgagttcttcccggctgacgattttatttttctgttcagccagcagttttaagatcagcatttcgtttttggtcagttcgaccgaaccgtttttacggctgaccgtgttggtttctgtgtcaatgaccgccccgcaccatcttttcatcagcgccggttctgtgccgtattggtgcacacggcggaacacggcctgtattttcgcgattaacacatcaaagtgaaaaggcttctgaataaaatcatctgccccgagctgcatcgacatgaccatatccgcgggatgatcgcgcgaggacaaaaagagaatcggcacgtttgattgggagcgtatcattctgcaccaatgaaagccgtcaaatttcggcagctgtacgtcaatgatcaccaaatcaggcttgatttcggtaaactcccggatgacccggctgaaatcctttattccgtgcaccgcaaatgaccagcccgttaatctctctttcatctcgtgaaacaaagtgttatcgtcttctattaacaaaatgtgaaacatggtatccgcccttttctgatagatagaggaaaaaccggctgatgtccagccggcttttttcctttacagttctcttcttaatgcggtcagaacgttggtttttgtcgctttgcgggccggattcataccggaaattaccgcgacccccgcacaaatgacaactgcgatcacaacgaggctgagcgggatataggagaaggtataatgaagatcttcagctccggtgtttccccctaccgctttcaagataaccggcacagccagattgacggcaaaactcactccgtaagaaatgataatcccgatgacagaacctaatatcccgatataggcgctttccatcaggaacattctgcggatgatggacgggcttgcgccgatcgctttcataatcccgatttcctgcgttcgttccgtcaccgccatcgtcatcgtattgaaaataccgatggcagaaatcacgacggcgataaagccgacaaagatcaggccgattttaaagacgaggaaaaaggtgttgacgcccttcagctcggttgtgacagatctgacataaaagccgtcatccgtgaggtcatgggtaagctgatcgacatgatcgaatttgtccgcatacacattgatgcttttttccgcatttccattcttcagatccaagaatgtcgagaagtcttttttgaattgatcactcacaaaaatatttgtatcctccatccaatcttgggacggtttttttgtaattccgactactttgaagtcgtacgttttcgttttttcaacgtctccgtctttgtttgttttggagatgctcagctgtatcgttttattaagcaggtctttcgtatagccttttggttttttcacctccgacatgtcgccttggtgatcctttaactctttgtcgtaagcgtcagcctcttttttcgtcaataggttcttcgcaaaatcatagccgaccacgatttcattctctgtgcgggcgactcttccctgatcaagctccatattggctttgacttcatctttcatgtttgtcagcacaatggctgaatcttcatttgttcggtttcccaatgacgctttgttcggttcatacacttgtgttctctcaacgacagacttgacatttttatacttttccaagtctgatttcttcacggcttttccgttctcttggccgagcacattgatttccgtaacaatctgctggctcatggtaatgtctgtaatcgttttttggatgccgaatccgacggaagccagcaccactaaaaacgcgcacgccattgtcgtcgccagcaccgtcatgaaaacacgcagccggtttttcttcatatttcttctgataaagtgaatctgatccttaaatctcaacagtaacgcccccttttaatacaccgtcatgcagctggaattttgaatgcgcgatcgaagcgacttcatcgtcatgcgtaatgatgacaaatgtaatcccgcgctcccggttcagctgctgaattaatgcaagcacctcaagttccgtttctgaatcgaggcttcccgtcggctcatcggctaaaataattgacggatttaaaatgagggctcttgcgatactgacacgctgctgctggccgcctgacagctcattcggataatgattcgcatgattctcaagtccgacccgtttcagcatatccgcgactttctgcttgcgttcagacggtttgacgccttttaaggcaagcggcatttcaacattttcataggttgtcagactcggaatgagctgaaagctttgaaaaataaagccgaaatacccgaggcggaactgcgcccactctttttcattgaaacccgtcacatcagtgccgttaatgacgatacggccctttgtcggcgctatgtatcccgaaattaaattcagaagcgttgattttccggaaccgctccgcccgacgatacaggcaatttcccctttttcaacggtcaaagagacatccttcagtaccggaacctcactctctctgcctttcctgccgattttaaatgaatgatcgatatgctgtacctctatcacgtacaccactcccccttatatctgtttcgtttttttatagatgaagtaataactgatgaaaaacccgataaccgcaccgatgagcatgccgaatatgtaaccggtatacgaaccgttataagcatatccgcatacccccgcacttcccatcatactgagcgacatgacgagcacttgaatgatgcgttcaatgtgtttgctcaggataaaatgtccgcttcgttcattcggcattttcaggaaattcacatagccgaatagatagaaacaaaatcccattaatgcggagatgaacaatgcgtttttcatgtaatacatccatgatgtatggatgtaagccgcaggcatgaaatagatcagaaatccgctccaagggaaatcaatatccggcacagcctgcctgccaaaaaggaactcagcgtttaacaggtaaatcgtcataaccacgatcggaaagacggaaaccgtgaacgctgtgatcagctgcgccgctaaattgcccgttatcgtgccggcagctgtcactaatgcataaatcatcaagctgatgaccagcatccctgcgctgaatgattgaaaatgatggacagcgtcaggtttaagcgctagaaacaatatgtctgatactccgtaagaaacaaactgcgagccggctaacacggctgctcccaagaaaaacttcgtatgaaatatccgacttctcgaatacggaagactcagtgtaaacatcctttcagcccggcctgctcttatcagaaaaagccccataacaaccggcggaatgaaatgaagcccaatcaaattccgataattgctgtaatcgatgctgaatgtacaaactgaccccgggtacagctgaagtgcacgtaaacaatccttatagtgaaaatactcatttataattgccaaagggcctaagatagataagaaccccgctgtaagcagcagcagcgtctgccgctgcttacattctttataaagcaaaccgctaatcggcaccttgccttcctccaaactgctcattttcaaacggatctacatatgctttgacttcctgtaaaccgtaaaataactgatgaaaaacccgataaccgcgccgaagataatgccggctaaatagccgaacatcgtgtctgtgaccccatatccgaaaacaccgaaacccataacggcaaacgcaatcaccaaaatctgcaccggacggtccaattttctccatagaaagaatctgccgttccgttcattcggatgtttcagaaagctgacgtaaccgatcagataaaagacaagactcatcaccatcggaatgattaaaaccaaatccctttctctgatccactcgttaaacacatatccaataggggttacaaatataaaaagacgggattcgatataactgctgataaaagaaaattgatctcccacactaacaccgaaaacgacctccaaattcgcggccggcagaccgatgagtaaaaaaggcagaatcgttacggtaaacgccgttaacagctgggcgaatatatgtcccgttattgctccggatgccattaacaaggcgtaagccataaaactgatgacaatcattccgattgaaaaatgatcaaaatcgtacgtatggctcggtttcagcaaagatatcagcaatgacgccgctccatagcctatcgcctgaggaacaacaatgactgccccgccgagccagaatttagtctgaaagatttggcctctgctgtaaggcatgcttaacaaagcatccatcgttccctttgtccgttccaagcctaataagaagacagcaatgatgacactcacaatccagctgaaggaaagaagcgacccattcgtataactcacggtaaattcacaatattgcggatccagataattcaaacgtccttggtatgataaatagtagtaataaatcataaaagggtttgccgctattaaaaaaataccgctcaacaaaaacaaccactgatttttcttccattctgtgtacaacaatccccgcggtatcattccggtcctcctttcttacacatgcttcgtttttttatatatggcaaaataactgaccaaaaatccgagaactcctccgaccagcatcccggccacataccctgtcatcgtctgtcccgtcgagtaccccgccaggccaaaaccgagaacggcgatgatgatcaccacaatctgaatgggccggtcaagctgtctccagagaaaaaaatggccgttccgttccaccggctgcctgacatagcaaaagtacccgatggcataaaatacaatgctcatcactgccggaatgattaatatatacttgctggcagatacccaatctgtatccatgtacatgatcggattcaaatattgaaaaagattgtatacttcgagataagcatcttctgacggcatcagctcatacatgccggctccgaaaatgacttccgcattggacagcggcagtgtaataatcaggtatggtgatatcgacacagcaaacgccgttaacagctgggcgaacgtattccccgttaagcagcctgcgctcgcgaccaatgtaaaagccaaaacactcacaataatctctccgacgctgtaatggtggaagaaatatacgcgctcaggctttaacagaagaatgagcagctcagccagcccgtagccgatcacctgagcgccggtaatgaccgccgccccgagccaaaatttagtgtgaaacacctgagcgcgggaataaggcagactgaaaagcgcatcaatggttcctttcgtacgctccagtccgaataagcaaaccgccaaaatcacagcgggcgcccagtttaagttcagcattccgctatccaaagaattcacataaaacttacaatatgctccgtgggtgtccagacagccttgataaaccagataggtatttaacacttcaaatggattgaccgccgctaaaaaaatgccgaccatcacaagaacagttcgattctgcacccattccctgtacagcaatcccctgtctaccatctccggttccctccaaacttcgcgatgaaaacttcttctaagttcacaggaagctcgttccatactttaggctgcagctcttgcagaaagttctttttcttctcatcgttcttttgaatcagcaccgtataaaacacaccggcatggtcgagaatcggtatattttgttccctgatcttcaaggcgacgtcctcttcaaatgccatttggattttcatgtactcttccttcatatcatccaagtccatcacattcgtcagctgatttccttccaaaaacccgatccggttgcacattcgctcaatatcttctaaacggtgtgaggtaatcagaatgctcgtttcccgttcagctacttcatccaccataagctgaagcacgtcatgacgcgttacggcgtcaattccgtccgtcggttcatccaaaaggataagagccgggcgtgaagcaaaggcaaggacgagcgcaagctgttttttcaggcctgtcgataattcacgatatttcttcgtttccggaatgccgtacctgttcatcagctcattggcgtaagtcacatcaaaattcggatagattctgcttacaatcgcaacaagctgtttatatgtatacttgtcataaaaaggattttcaacaggcatataaatgatattctgtttgactttcggatgacgctttatttccacctgattaaataaaaccgtcccttgatccggaagcagaatctgctgaatgagccggagcagtgttgttttccctgatccgtttcgcccgagcagcccgaaaatttccccttttccgatggtgagcgaaatatctttgagcacttctttaccgtctatcgtttttgagagattccgcaattcaatcatgatccttgcctcctttcacatcagcgctgatttcctttatccattcctgcagcttctccagctcaactcccgcgtaatgggcatcgatgatgagctgtttcaattgctcttttatcatcgtcatcttcccttcaaccaatgtcgtttttgcattctccgatatatacgttcctcttcccctcagcgtttcaatgacaccatcgcgttcgagctccttgtacgctttgctgactgtgttcggattggcgataataatcgttgccaattccctgacagaaggaagtttatcccccggcttcatgatcccttttaaacaaagctctttcaattgctgtatgatctgctcataaatcggagttgagcttctcggatcgatttgaatcatttacttcccttctttcttttacgagctgctctctttctttaaatgttctgccattgaaaaccgatgacgacaagaacgacaaacagactgctggccaaaaccgaggcggcgataataagaggcacatcttgttttacggatcttttgtttttcatgaaagttccccttccctatgcttaacatttatatgtcgatttcattttttgagtgttttatgtgtattacatcaagtagtacacgtaatacaataaacacactcaggcctattgtcaattcttttttaaaagaaatacaaaaaaacccgccgggattccggcaggtttgctgaaccatttgaaacggcgcggtcagtaatcaaaattacgctgcaaaatcatattgttttgcaaggtctgcagctgcaatctcattcggtaaagctgctctctttgctgatcattcgcagataatgacagcttgtttaattcattcaccgcgttttcaagcatcatttgcgcttcactgtactcattatcattataatgctcttgttttgaagcggtcataaattgctcattcgcaaattcatacgcctgttcgcttctttggagatgttcatctactgattgtcttgttgccaacgaaacccctcctcagtgaatgggaaatcaagcttagtttgagcggacccaaaataataacacccgaaggttgcaggaaagagaaccaaattttccgtgtttaagctaaaagaatgagaatcctgcctggagtcataataaacaaaagaaagccgcatcctgttttcagattgtgaacccccatcattcatgctacaattttaggatgcatctgatgtgagggaggctttttgaacattgaacgagaataacccttttccttattcaaatacggaaaaacggtaccatacattaaattatcacctgcgggagcatttcgggcataaagtgtttaaagtcgcgcttgacggcggttttgactgcccgaatcgggacggcacggttgcacacggcggctgcacattctgcagcgcggcgggctccggtgattttgccggcaatcgagccgatgacttactcacgcaatttcacgatatcaaaaaccgcatgcacgaaaagtggaaagacggcaaatatatcgcatatttccaggcgttcacgaatacgcatgcccctgtagaggagctgcgtgaaaaatttgaatccgtcctcaagcttgacggcgttgtcggcatgtctatcgcgacccgtccggactgcctgccggacgatgtcgtggaatatttggcagaactgaatgagcggacctatttgtgggttgaactcgggctgcagaccgtgcatgagcggaccgcccttctgatcaaccgcgcccatgattttgactgctatgttgagggtgtcaataaactgagaaaacacggcatccgcgtttgttcccatatcattaacgggcttccgcttgaaaacagggacatgatgatggagacggccaaagccgtcgctgatttggatgtgcaaggcattaaaattcacctgcttcacttattaaaaggcacaccgatggtgaagcaatatgaaaaaggaaagctggagttcctttctcaagaagaatatgtaagtcttgtatgtgatcagctcgaaatcattcccccggaaatgatcgttcaccgcattacgggagatgggccgatcgaattaatggtcgggccgatgtggagcgtcaataagtgggaagtactgggcgccattcaaaaagagctggaaacacggggaagctatcaaggaaagctcttcagaaagatcggggaggagaccgccctatgaccttgatgcacatcctccctttcagtaaagaattgctgaagtccgccgcacaggaaggtgatatcacggttgacgcgacgatgggcaacggacatgatacatatttcctggccggccttgtcggtgagacaggacatgtccatgcctttgatattcaagcggacgcactcgctaaaacgaaggagcggctcggtgccgacttcggcccgcgcgtcacgcttcaccataagagccatgatcaaataaaggcatcgctgcctgaagatgcgcacggtcgtgtggcttgcgccgtctttaatctcggctatctgccaggcggcgataaaagcattacgacaaacggtcactcaaccatttccgcgatcgaacagctccttgaactgctgaaggagaacgggctgatcgttctcgttgtgtaccacgggcatcctgaaggcaagacggaaaaaagtgcattactggaatactgcagcaatcttgatcaggaaaaagcccgcgtgctgagctacggctttctcaaccagcaaaacgacccgccgtttattatagcgattgaaaagaaatctgccggcaaataaagaatcggcctgtcataagcgggccgattctttttgtatttacttttcaagaaaaatcaattactatgaaataatggaaaaaagttcatcttttaagcgtaacatctgagaggagcggcagtttgaatattcttcgcatcatattttcaagtgttccctatgtaatgtttgtcatcattttatcaagacatttaggatttgagttcgcgaaaacctattactggtggtttgctgcattttttgtcatcgggctgatcggcaaattcgcaatgcaccttgcggcaaaaaagaaaccgttaaaaaaagagacagcgtaaaatgcgcatgtctcttttttatcagaaatattaagtgtaagcactttcacccattacgaacttttcgtccaagccatcttctgaaatttgcggtaagctcttccgttgatataaaagaaaaatgacgtttttccgcttgccctgatcagctttcgcgcgaggcggcccatttctttttggccggcgactttgtcatcggataaatagacgccgagcagccccctgttgatcagccggtgaaaattttcatgcggaatgccttgcaaatgttcatccgctttttcaataaaatgctgcagtctctgcatcatttcttcatgggactgataatacgtacagaaattcagatcgccttcaagcagatcttcttcctggtcaattaaataatcgagcagtatgtgcagcccttgtatgtacggaaaataactgctgcggattttctcagcggtatgttcgttaaaatcaggctggaatgagtaagcaacgagacagaaaatgcctagcgtcgatcccgcgcaggccgagaactcaaaccactccatttccggaagctgcgaccggtactgctcaaaccaggctttaagcctcggaacgcgttcatgctcaacgacatgcttatgaacctgaagatcgcaataataatcacacagctcaagcaaataaggtttaatgataccgtaatgttctattgacccgagcacccgctggcatgttctgaccagctcatgaagataaccgccgtcatcccgctcctctctgtactgatagtacggccgcacctcggcaccgaccgtcagcgcgtcacgcatggaaagatgaagcatgcggaagtcctccggatcaagcgaggtgctgcggtcgcacagattgtccagataatcactgattgtctgatacgcgatgataaattgcacgcatttctgtttctgctctcccgaaagcagggctaaaatgccgcctccttcacaatgaaacgacttatcgcggatacttgcggccgcctgctgccgcagttcggtatttttaatggaatctgatttttcccgccacatgttcaattcctgatgaacgagcggaaaaatttcccgatacacttttgccataaggttaaaaggatgttccggtactgtcaacatatgcacccccagcgaattcaaatatactgatctgtaaaggcttttgccgccttaaacacagtttctctttccggttcattaaaaatttcatgataaagcccttcccattcccggtacgatttattatgggaagccacaccggaaaaccatttgcggactttcattttatcgacgattttgtcatcaccgccctgcataagcaaaagcggcacctttaaaaacgcatcagtcggcaccatagcggcatcaatggtttttaaaagctctctgtaccatcttacggataccttcgtgacatataaagaatcgttttgatccgcttcaatcatatccgcattcctcgttgccatatcaggtgataagccggaatccactctgagggacggagcgaggacgttcagtcctttagacgcaaaatcaaggactttattgacttttatttgcagacccagacaaggtgatgataaaatgagtgccgtaatgcggggatttctctgctgcttaaaccattctatcgcaatcagtccgcccatgctgtggcccaaaaggaaaacgggcgcttcaagcgttctcgctttatcaatccatatatctacttcatcaatgtattcttggaaagagcgaatatgccctctggcgcgggtcgacgttccctgaccgggcaaatcgcccatcaccacgttatatccggaagatctccacatttcaacgagccatttataacgcccgtggtattcgctcgccccgtggataatgacaatggtaccgacgggcctgtctgctttccaagtccacatgcagttcacctcttacataaatttagagaaagaaggatgagacatgataatctacccttataaacaatttacgccggacatacatcctgaagcgttcattgcggataacgccgtcataacgggcgacgtcgtgatcggagaacaatcgagcatctggttctcggcagtcatccggggggatgttgcgccgacaaggatcggaaaaagagtcagcatacaagacttgagctgtctgcatcaaagcccgaaccgcccgcttcttattgaagatgacgtcacgatcggccatcaggttacactgcacagcgcaatcatcagaaagaatgctttaatcggtatgggctccgtcattcttgacggggcggaaatcggagaaggcgcgtttatcggcgccggaagtctcgttcctccgggcaaaaccattcctcccggctgtcttgcgttcggccggcccgcaaaggttatccgccggctgacagaagaagacatacgggacatggaaagaatcagaacggaatatgttgaaaaaggccgatactataaaacaatgcaagagaaataaaaaagatcagctttgttttactactgtaccatttttcaaaatattatttaagtaaaaaccatttgcattctcccgattgtcaggaaacagaagcaaaatgttcaggaatttgttttattcttcccccttttacccgatcctatgaaaaaagagcccatttcagcgggctctttttttacgctttttcggcgaatgtctgtccgttttccagatctatgtcttttcttttatggaaacctttgccgtaataggcggctaataatatgccgaaccagacaggaccgatgatgacggccaccctggtctctgcatcaaaagccatcagcacaacgacaaaagccagaaatgccagcgagatatatgaggaaaaggggtataaaggcattttatatttgagttttttccgttcttccggctgtaagcttttacggtatttcatttgggaaagcaaaataatcgaccatgtccaaattgctccgaacgtcgcaatgctcgtcacccacgtaaacactttcgccggcaccacgtagttcaacaggacgccgatgcataacgcacccgctgaaaccaataccgcttttcccggcacaccgccttttgtgaccgtaccatatgctttaggcgcttcattttgttccgccagattgaacagcatacgccccgtgctgaagatcccgctgttgcaggaagaaagagccgccgtcaatacgacaaagttaatgattccggctgcagcgggtattccgattttttcaaatgtcaaaacaaacgggcttccgcctgaaccgatttcctgccacggataaattgacataatgacaaacaaagctccgacgtaaaaaatgagaatgcgccaaaaaacagtatctatggcccgcgccagtgatttttccggatttttgacctcaccggctgtgacaccgatcagctcaatcccgagataggcaaacatgaccatctgaagcgacagcagcacccctttaatcccattcgggaaaaagccgccgtggctccataaattgctgattccgagcgcaacgcctccgtttccgagaccgaatacgatcatcaccagaccgatcgcgatcattgacagaatcgccaagactttaatgagcgcaaaccagaattcaagctcaccgtacgctttgaccgccagaaagttgacagccgtcataatgacgagtgcacaaagcgcccagatccatgacggcacgtcagggaaccagtagcccatataaatgccgaccgcggtgatttccgccatgcaggtaacgacccataaaaaccaataattccagcctgttaaaaacccggcaagcggaccgagataatctctggcataccggctgaacgagccggctacaggcttttgaatcgccatttcccccaatgcccgcataataaaaaacataatcagtccgctgcaggcgtaagcggctaaaatccccggcccggcaagctttatggcagaagctgacccgagaaacagcccgactccaatcgcggcgcccaacgacataagcgagatatgccgctcttccaagccgcggtgaagcgttttttctttgttttgcataactctccctccccctgattttgacaaagaaacaacaaaccgagacgaaatagccagaaaactctttccggaatctacccgattagtcctattataacctttttctgaatattgcgtaatactttgtcgaaaacagagcggaatagacggtttacaaaaaacaataaaaaaaaggccttcgataacatcgaaagcccttttggattaaacgaaaatgacttctttcggctgatgattcagctcttccggcaccagtcttttttcaacattgatactgtgccagatcatgaagatcagcacggtccagattttgcggctgttgtccgctctgtcggcacaatgatcttccagaagctgaaggacataatccttttcaatataagcatctgtttcactttcacgaatgatgttgcgaacccattcgttcatttcatttttcagccagtggcggatcggcacagggaagccgagttttttgcggttaagcacatgatcaggcactaccccttcagcagctttgcgcagaaggtatttcgtcgtgccgtttttcgttttcagttcatccggaattttagaggccacgtcaaacacgactttatcaaggaacggcacgcgcagttccaatgagttggccatcgtcattttgtcagcctttaacaggatgtcgccgcgcatccacgtatggatgtcaacatactgcattttattaatgtcgctgtatgaacggctttccgtaaagtacggcttcgtgacatcacggtatgaaagctctggattgtaatgtttgagcagctgttttttcacgggctcttcaaaaatcttcgcattaccgatatagcgctcctcaagcggtgtgcagccgcggactaagaggcttttccctctcattccttcaggcatgacggacgccacatgaagaagcatttttttcagaccggacggaatgcgttcaaacggtttaagcgaaagcggttcgcggtaaatattgtacccgccgaacagctcgtccgcgccttccccggataatgcaaccgttacatgctttttcgcttctttcgcgacaaagtacaaaggaatcgccgccggatctgcaagcgggtcatcaaagtgccagacgattttcggaagctcattcatatactcctcaggagaaatgactttgcttatattttcaatcccgagcgcggcagccgtttccttcgctacgtcaacttcactgaagccctgctgctcaaaaccgacggaaaatgttttaaggctcgggtgaaattctttcgcaactgagacgataaaagaagagtcgataccgccggatagaaacgaaccgacaggaacgtcacttctcatgtgaactttgacagagtcaaagattgcgtctctgacttctttcaccaatttatcttcatcagactgaacaggcttgaagttcgctttgaaatatgttttaaacgcgatgtcgccttccgggcggatcgtaaactggctgcccggctcgacttttttcacttcagcgtcaagcgtgctcggttcaggaacgaattggaaagacatatattgctgtaaagaagctgtatcaagatcaataccgttttgagcggccattaaactctttctttcagatgcaaaatatactttgtccccgatggttgtgtaatacagcggtttaattccgaacgggtctctcgcgccgtacatgacgcggtcagctttgttccagattaaaaacgcaaacattccgcgaagctttgaagcggcttcttctttataatgacggtatgtcgcaaggagcacttcggtatcggaatctgtattgaaagtgtagcctttcgcttcaagctcttctctcaattcaatgtagttatagatttcgccgttaaaaatgatccaatatttttcgtcttcatatgataaaggctgtccgccgttttctacgtcaataatactgagccgtctgaagccgaatccgacgtgctcgtcatgataatacccatcgctgtcaggaccgcggtgaacgatcatttggttcatttgtttgattagctcttcttgatctgcggtttgagttaatggatgcttattaaaaacaccgacaaatccacacatagtatagcctccataagtgtaattttctaattggaccccctttttatagacgctttgttacgccattggtttcacgctatgtaaaaaataagcatggcagcatctacaaaaagggaaagccgcttaagtaagcggctataaaattattctcctagtgcttctttgcgaagcgcatccgccttgtcagtacgctcccaaggaagatcaacatcatgacgtccgaagtggccgtaagcagctgtctgcttatagatcgggcggcgcagatcaagcattttaataatgccggcaggtctcaggtcgaagttattccgtacgacttcgatcagtttttcttcagaagcttttcctgtatcaaatgtattgatggaaatagaaacaggctgtgccacgccgatcgcgtatgcaagctgcacttcacaagaatcagcaagacctgctgccacgatgtttttcgctacgtatctcgcagcgtatgccgcagaacggtctaccttcgtcgcatccttaccggagaatgcgccgccgccgtgacgtgcatatccgccgtatgtgtcaacgatgattttacggccggtaagacccgcatcaccttgaggtccgccgattacgaaacgtcccgtagggttgatgaagtattttgtttcttcatcgatcagttcctcaggcacgacagggttaatgacatgctctttcagattgcgctgaatctgctcaagcgtaatttccgggtggtgctgagttgaaatgacgatcgcgtcgatgcggaccggcttgttgttttcatcatattcaacggtaacttgcgttttgccgtcagggcgaaggtacggaagaatgtcttctttgcggacttcgctcaaacggcgggctaatttatgcgccaaagagatcggaagcggcataagctctttcgtttcgttacacgcataaccgaacatcaggccttggtctcccgctccgattgcttcgatttcagcatcgctcattgtgccttcacgcgcttcaagagcctgatcgacacccattgcgatatccgcagactgttcatcaattgatgttaaaacagcgcaagtctccgcatcaaatccgtatttggcgcgtgtgtagccgatttctttaatcgtttcacggactgttttcggaatgtcaacgtatgttgatgtagtaatctctccgcttaccagcacaagtcctgtcgttacagatgtttcgcaggccacgcgcgcgttcgggtcattttttaaaatctcatctaagatactgtcagaaatttggtcacagattttgtccggatgaccctcagtaacagattcagatgtaaatagtcgacggtttttactcattcacttttcctcctgaaaaaagatcttttgcaagaccttctcatatgatacggaactcgctccctcttaatacaatgtcatactatatcagagaatgttaattggcatattttatgaaataaaaaaaccttttccactcgaggaaagggtttggtctgtgtgcctttcactcttatcgctcaaggaaaatattaaaccttgcatcaggttagcaccttggtttcccacagtgttttcacctgcttttttacagagaaaccggttgctgggcttcatcgggcctgtccctccgccagctcgggataagagtatccgctcaatgaaatatcttatcgtaaaagggcggaaagtgtcaatatgaattaaagcgattgcgcgcctttatttcgggaagcaatggaaaaacacaaacaaaaaaccgcaaatagtatagactattttcagatatatgttatactaattccacattcagcgaaatacaaataaaccggcaaaggaaggtttttatgaaattagttgatttaaccgcagatcttcaagcattacttgcaagtccgaatgtgcatcataatttatcggctccaaaacttaccgaaaaagtaatcagccgaaatgaaggaacgctgacatcaacgggcgccgtacgcgccaccaccggcgcatatacaggccggtcacctaaagataaatttatcgtccgtgaacaaagcacagaaaatcaaattgattggggcgcggtgaatcagcccatttctgaagaggcgtttgaaaagctgtacgccaaagtcgtcagctacttaaaacagcgggatgaactgtttgtgtttgaaggattcgcgggagcggatgaaaaatacagactgccgattacggtcgtaaatgaatttgcgtggcacaatttattcgcgcgccagctgtttatcagaccggaaacggatgaaagagacccgcaagcgcagcctttcatcattctctcagctccgcattttaaagcagacccggagacggacgggacgcattcggaaacatttatcattgtctctttcgaaaagcgcgtcattttaatcggcggtaccgaatacgccggagaaatgaaaaaatcaatattctccattatgaacttcctgcttccgcagcaggatatactgccgatgcactgctcagccaacgtcggtgaaaaaggcgatgtcgccctgtttttcggcctttccggcacagggaaaacgacgctttcagccgatgcggaccgcaaactgatcggagatgacgagcacggctggtcagattccggcgttttcaacattgaaggcggatgttacgctaaatgtatcaatctgagcgaggaaaaagaaccgcagatttttcgtgcgatccgcttcgggtctgttcttgagaatgtcgtgcttgatgaaaaaacgggtgaagcggattacgacaattccttctacacggaaaacacaagagccgcatatccgattgagatgatcggcaatatcgtgcagccgagcattgccggccatccgcaggcgatcgtctttctaacggcggacgcattcggcgtgcttcctccgatcagcaaactgacgaaggaacaggcgatgtatcacttcttaagcggatacaccagtaaactcgcgggaaccgaacgcggcgtgacatctccgcaaacgactttctcgacgtgcttcggttcaccgttccttccgcttccggcacatgtatatgccgaaatgctcgggcgtaaaatcgacgaacacggcgttcaagtcttcctggtcaacacaggctggaccggcggagggtacggagtcggagaacggatgaaactttcgtatacaagagcgatggtcaaagccgctattgacggcagactgaaccagactgacatgacggcagacagcattttcggcctgcacagtcccgttcatgttccgggcgtgccggatgaagttcttcagcctgaaaacacatggagcgataaacaagcatacaacgaaaaagcgctgtttttagccaatgagtttaaagaaaactttaaaaagttttcccatgcagactcgattgccaaagccggcggacctctcgtgtaatcaaaaaagccaagggcgtttatgccctcggcttttgttttttcagtttgtcgaatgaagcgaagtgagtctgtatgtaatgcttgtccggccgttcgcccattcgagcttttggacctcgccggtgccggatttctctccggttttcgttttgcgcacgtccatcggaatatcaagaggatagacgcggtagccctctttctccaataaaaagatattttcctctatccgtttttcattgccttttgtcacaatcatggtattaaattcaacaggcattcccaaaatgaaaatcccctttcattctcttattctttattatcatatcataaatcaggcatcttaccgtgtcttcatccattccgccagccgccggacaatgcgtctgttttcctgcggcggaaaataatgcgtaaaaccgctgtaataccaagtttccaccggtttccccgcctctttcagcttgtcctcgatcatccgggcgtgttcgatcgaaacattctcatcattctctccatggatgagcagcacaggggcctgaatgcggtctgctttttcaaacggcgaacgccatctgtattcatccggcacctttttcggcgtgcccccgatcacccgcttcatcatccgccgcatatccttccgctcttcataagtaagcaccatatcgctcacaccgccccatgaaacgagtgaagccgcttgatgccccatttcaatcgcggtcaaaagccccatgattccgccccgggaaaaaccgaaaatatgcacccgcccttccctgacgttcggatgctcccgaagaaggcggaaagcggaaaacgcgtcctctctgtcctctcccgcaaaatcttcatttccctcgccgccctggttgcctctgtaataaggcgcaaacacgacaaagccttgggaagcgaattgaacgattcttccggggcgtaccatgccgacattttttatgccgccgcgcaaatataaaaaaccgtcatatgttcccggcgccgcaggttcggcaaggagcccctttaccttcagaccttctgactcatagcataccgcaaagaggcggacatgcggactcggagacgggaaccttttcttttctaccagcaaaacaatgcgcctccttatatcatcagtttttttattctttcccaacgtgaatatgggcactcacacattttttatacccatcatacgatatgtaaagcagaaaaggttattttaacgcttaaacaaggaggttacaccgtgaacaaatggctcaaagcgggctgcgtttttgtcatatgcgcctttttcctgctcattcttccggcttgcagacaggaagaaagtctgacgaaggtaaaggtggcggaagtcacacactccatcttctatacgcctctgtatgtcgctgaagcaaaaggtttttttaaaaaagaagggctccaagtgtcacttcaaacaacatggggcggagacaaaacgatgacatcgcttttgtcaaacgggtcagacatcgcgctggtcggttctgaaacatccatttacgtggaggcgcagggagcaaaagatccggtcatcaacttcgcgcagctgacgcagacggacggcacatttctcgtgtcgcggaaggatgagaaatcattcaaatggaacgatttaaaaggaaaaacatttctcggccagcgaaaaggcggcatgccccaaatggccggtgagtacgtcctgaaaaagaatcacatagagccgaaaaaagacattaacctcgttcaaaacattgatttcgccaatatttccaacgcattcgcatccggaacgggtgattatgtgcagctgtttgaaccgacggcatcccaatttgaaaaagaaggcatcggtcatatcgtcgcatccttcggagaagcttccggccaagtgccatacacaacctttatggcaaaagaaagttatttgaaaaacaatgaaaagacggcggaaaaattcacccgcgccatttatcgcgcccagcaatgggtggaaagccatccggccaaagacatcgcaaaaacgattcagaaggaatttgccgatacagacccggccattatcgaaacatcgatagagcgctataaaaaacaaaagtcattctctgcagacccagttctgcaaaaggatgaatgggaactgcttcaatctattatggatgaagccggagagctcccgaaacacattccgtacagcaaactcgtcaacacaaaaatcgccaaaaaagtcacctcagaacaataggaggaacatgaatgtcttttttacatgtggatcatgtaacacatacttatttctcgctgaaagaaaagacaaccgccgtgaaagatatacattttcagattgaaaaaggggatttcatctcctttctcgggccgagcggatgcggaaaaacaacactcctgtccattctggccggacttatcacccctgcgcaaggccgggtgctgatcgaaggaagcgtgccgaaccataaagaacaccaaatcggttatatgcttcagcaggattatttatttccttggaaatcaattgaggaaaacgtgctgctcggtttacacatttcaaaaacattaacagaagaaaaaagagctgaagttctcagccttctgcctaagctcggattaatcggcgttgaaaagaaatatccgaaagagctctcaggcggaatgcggcagcgggcggcacttgccagaactcttgcgccggaccctggactgctgctccttgatgaaccgttttccgcgctggactttcaaacgaagctttctttggaaaaccttgtcttcagaacattaaaggattttcaaaaaaccgccgtgctcgtcacccacgatatcggtgaagccatcgccatgagcgatacgatctatttattttcgaatcagccgggcaccatccaccaaatattcaccgtgcctaaggagctcgcggctttagatccgtttgacgcgcgtcaggatccggcctttcagccgctgtttcaaaccatatggaaggagctgaattcccttgaaaaacagcagcggcacgattgaacagcttcatcagcagtttaagaaaagacaccaaaaagaaaagctccggatccgtgcgtatcaggccgccattttcatcgtattttttgccgggtgggaaatatcgagcagggcgggctggatcgatccgttaatcttcagctcaccctccgccgtttgcaggcttttagttgaaaagattgcggacggatcccttgcggcgcacatcggcgtaaccttaggagaaaccgttctcggctttttgctcggcacgcttctcggcacatgcctcgccgctctgttatggtggtcaaacaggctcgcccgggttttagacccgtacctcgtcattttaaacgcgatgccgaaggtcgcactcggaccgattctcatcgtggcactcggaccgaatttcacaagcattgtcgccatgggagcagtcatcagtgtcattatcacgacaatcgtcgtctttacggcttttcaggaagtggatgaaaactatattaaggtgatgaaaacattcggagcgaaaagaagcatcatgtttaaagaagtcattctgccggcatgcgcccccgcgattatttccgcgcttaaagtgaacgtcggtttatcctgggtcggcgtcatcgtcggcgagtttctcgtttccgaaaaaggtctgggctacatgatcatttacggattccaggtcttcaatttcactcttgtgttcttaagccttctgatcatcgcgatttttgcgacattgatgtatcagggagtcgaactgttagaaagaaaatggacgaaaggaaaaatataaaaaagacccgtgcgtaagcgccgggtctccgttttttatgattgaaatacgccgtcctctttcagctttttcagactgatcggaagcaccgaatctttcataatgaaactgaattttttatttcgggggagattctccggcagttcgctgaacagcaccggcccctttgtttcaaaatagtcagcctgtttttcaagcttttcaatatcggcaaaataaatattcttcacgattaccttttccctgccgagaactttatactgtccgacgtacttcagatgtcttaccgcggcgccggtttcttctttcacctcgcgcagggccgcttcctccgcacattccatcggctccacttttccgcccggaaattcaaacccccggtcttcgtgctcagtcaaaagccacttatctccatatcggcatatgacccatacatgcttcgggctgtctgaaaaaggctggtgttcaaaggagagctgaacagtattctgataatagtctttaaactcgtacatgtttatccctctaatccgttccttcatatcttccatacatcataccacagttgcgtttgttcggaagccctttatcaaaaattcagaggaaaaccatcctacccgctagtatagcctcctttgaagcaaatgttacggtttgcgcttgaatttatttttcagggtatccaataggtcgacgagcacctgcggaaccggtatgcccagcgagcttgccgtaatcacgatctgaaccgattcgtataagatataaaacataatagccaaattgcggatggcgccttctgaatgaagcagctgatcaaaaaaatggcaaactgagactaatgccagggtcacgatttttttgaccagccgcgcaaaaagctttcttgtgctcagctgctgcaaaagagattcttttaagcttgtactgataaactcaatcgccatgaccgatagcaaaatcagaaacgaatactgaaaaccgccaaagaaaaaccccgctgccgacacgatcactgcaaaaaacgaaaagatgccaaagtctttgcccacttgatccaacatcctttcacagaaacggccttacattattctatgaaaagtgaatggaacggactggatttttcagaaaaatggacaacacctctcttcggcagccaaataaaagaccgagtgctttatagccccggtcttcccttgttgattatcctaaatacgctttcagcatccagttatgtttttcgatattctggtgaatggcaagcagcatatctccggtcgtttcgtctccgacctcatctgcgagatccatgccgcttttcagctcttccgcaatgacagtgaaatcatcataaatgttctgtaccatttgttctgcgctctcattgccttccgcctcttttatagaagcagtcttcaatgattccgtcattgtgccgatcggcttgccgttcaatgccagcagacgttctgccagatcgtcaatatatgtagccgtttcgttatacagctcctcgaacttttcgtgcaatgtgaaaaagtccttccctttgacgtaccaatgatagttatgtaatttcacatacatgaccgtccagtttgcaacttgtttattgaccgcttccaatagtttttctgacatgcctatcttcctcctttgatttactattgatataccctatatatcgtgtgttaaaacataaatttttagcccttgattttacggatggaaaatatgttatgatttgttaaaaaggagggattttatgctgcttcttctgggcttcggctttcttatcgtgctcgccgtgctgcttttatccatctggtcgactgtaagagcttataacgtaaaacatacgattgacccgccggaggacgcatcaaaaggcttgacggataaaaacaatccttaatgatgatgcgtctgttcctcatggccggaggaatcatcggcagcttcagcatccccgacacgcacttttacagtcggcatattatgctgctgttttgccgttacgtgggattgaacggtatacacaccctcttcatcaaattcagtccgcaggtgatacgcccctttttcctccttggccttgcttgttttgctgcttcctttttttccatctttccatacttcaaacatgacttcatccgcatccgtgacacgcttgccgccgtaaaaaacctccgccttgtattccgttttttcatgcggtgctgccgtttccggtcctgtaagcttgacctcaagcgctttaggctcctcatccgcggaggttttgtccgaattgcccccgcaggaagataatagaaataccataccgcacatacctgccaatacagcccgtttcatcccatcactccttcatgtttgcttctattttagcaaacgcttacacataaggtgtgacattttttagaaatatgtaaaaaagcctttttgcatgtcagcaaaaaggcctgttttttatccgaacactttcagcaaatcttctttatcttgtgacagccagaaacgcatcagccgtttcgcgccttctaaatcatgaagtttcgcctggccgcactgtttttcgttggccgccggaatctccgtaatatcgatggcttctttcagcgtagcgtcaagcaggtctacaatttcttccgctgtcggctcgccgctgacaacaagataatagcctgtctggcagcccatcggtgagatatctatgatgtcgaagtgatcgtatttctcagaatgtgtgcgaatcgtaaacgcaagcaagtgctcaagcgtatgaatcgtatccggcttcatcgcctgtttgttcggctggcagaagcgaatgtcaaacttattcacgacgccgtctgttccgactttatgcactccgcaatgtcttacatacggagccacaaccgcattatggtctagctcaaaactttctactgaaggcataatggcactccctttttttcagaatatgcatccattataacacagttttccgataagaattgtggcggaagcttttcaatctgaaattttttttctatactagcatcagaaaggtggttttttgatgaaaaccataatgattgcgttaatccgcggataccagaagttcatctctccgctgacgccgccgtcatgccgcttttatccgacgtgttcgcagtacggaatcgaagccgtcaagactcacggcgcattaaaaggcggatggctgacactgaagcggattttaaagtgccacccttttcatccgggcggtgttgatcccgtaccggacaaaaaacaaaaacattagtccatatgctggtagccgtcgatcaccagatccagtttaccggtttcaggatcaatcaccagaccgtgcaccgggacattgtcagggaatagcggatggtgtttaatgacgtttacgctgtctgtaacactcgcttctactgaatcaaagcttttcagccattgatcaagatcaacacctgagtgcttcagcatgtcaatccgctctttcggaataccgcggtcgataattttatcaagcatatcctcgctgttgattttgctcatgccgcaatcatggtggccgataacgcagacttcatcagcgtttaattcgtatacggccactaaaaggctgcgcatgatgcttccgaacgggtgggcgacaagcgcgccggcacttttaataattttcacatcgccgtttcgcatgttcatcgcatgcggaagcaattctacaagacgtgtgtccatacaggacaaaattgccatctttttatccgggaatttagatgtttggtatttttcataatctttgtttttagtgaactgctcattaaattgcatgatatcgtttagaagactcatcttggtgtttcctttctgcttttttattcacaatataacataaggcgggtcatttcgtcactccccgcacgagatgacaaagtgctcaataaataagacaaaccccattgggcttgtcttatttccccatattgtattttttgttgaactgttcgactctcccgcctttttcgttgaatttttggcggcctgtataaaacggatgcgtatctgagctgacttctactttaatcagcgggtatgtttttccgtcttcccactctgccgtttcctctgacgttttcgtagaatggcttaaaaagcggtagccgctgttcacatcttgaaaaatcacttgatggttatccggatgaatatcttttttcatgctgatctccctttctcaaatcgtaataattacgttttattctaaaccttaaataggcgcttgtcaatcatatatgccctgatcccttgatttctaaaccctgcacatatatggaatcggaagaataatctaatcgcttcagcaaataatataaccacattacataaaacggtaatttagaaaggcggtttatgatcgtggatgatttagtattagccagaagtctgttcgggacaaccatgggctttcatattatttttgcgacgcttggtgtcggcttgcctctgatgattttaatggctgaattgatttatcaaaaaacaaaagatccgcattatgccattatggcgaaaaggtggacgaaggcgcaggctgttctgctcggcgtggcgataccgaccggaacgatcgcgggtacacagcttgcccttttgtggcccggattcatggaggtcatcggcagggtgatgtcacttccgtttcagattgaaatttatgctttctttatcgaagcgctgtttatgtccatttatgtctacgccgctgatcggctgactccggcgatgcgcatcattgccgttattttcgttttgatcggcgccgcggcatccgccgtcttaatcacaaatgttcacgcatttgaaggaacgccggccggctttaaaattttaaacggcaaaatcactgacgtcgaaccgtgggcagcgttttttaatccaagctttttcaccaccgcgggccatgtcgttctgacggctttcatgaccggtgcatttatcgtcgcgtcagtagcggcttataaaatgctgagaacgagaaaacaggagcaggtataccgctttcaccgaaaagcgctgctgcttgccttaacgatcggcgggatattctccattcttgcctctttaaacggtcacgagtcagcccagcttctttacgaataccagcctgagaagcttgcggccgcagaagggctgtttgaaactagatcacacgctccgcttgcgatcgggggttttactgatgcaaaagaagaaaaagtaaaatgggcgatagaagtgccgtgggctttaagctttttggccgcaaacagctttgataccgtcgtcaaaggattgaacgcgtttccgaaagacgagtggccgcctttattcatccatacactgtttaacggaatggtcggcatcgggatgctgctcattttgtactccatcatcggcatcgtgtggagaaaaattttaaagaaagacagctttccgacttggcttttgattttatttttaaccgcaggaccgctcagtctgatcggaattgaattcgggtggatattcgcttgtacggggcggcagccatgggtgatttaccatctcctgaaaacgtctgatgtcgtcacgacaaccggttcaatcggtttgctgttcatcctgttcacagtggtttacgccattttggcagccgcagtcatttatgtgctgctttattatttccgcaaacatcctgttgaggaggatgtaaaagcggtggaatcctaacaatagaaagggctgaattgaaatggacattaccatggatgctctcattgcgatatcaatcgtatggggcttcgtgtttatctacgcggtcatggcaacgatggacttcggagccggcttttggtcgatgatttatttaaatagagaacaaacaaaggcgacaaacatcgccaaccgttatttgtccccgacatgggaagtgaccaacgtctttatcgtcgcgatcgttgtcgccctattcagcttctttccaggggcaaccttcgtgctgggaaccgttttattgatcccgggaagtattattttactgctcttagccatccgcagcggctttctcgtcttctccaataccgcgaaggaaagaaaaatcatgagatatatctccggaatttcaggcttcattattcccgctgtgctgattttggtccttccggtcacacacggaggatttattgaaaagacgggcggagtgtatcacctaaatttggcaaatgtctttacaagccttaatgcgtatgcgtttatcggctttgccattttaagcactttatttttatcttcactgcttctggccgatttttcaaatgttgcggaagaggagcatgcgtaccgcatctacagacggagctctttaataacaggtccgctgtcgcttctgtttgccttcttcattatgctgacattacgctctgaagccgggtggctgtatacggggatgatgaaagacaagacatggctcattctgtctgtcattacatttatcattgccggcgtggctctgtttttgccgaataagcgcttcggccgcaacctcggcaaaccgagaatcgccatgatcgccatagcgcttcaatactttttggcaagctatgcatacggacgggctcatcttccttatatgatttatccggatattacggtcatgtcaggatttacggagcctgcaaccttcagggcgctgtttatgacgtatatcgtcgctttcatcattttgttccccgggttttatttcttctggaagctctttatgaaagacagacgttatatccgccaggaggaataacaaaaatcagggcggctcatactaatggcgtaccttttatcttggaggggagccagcatggaccaaaaaattctgtgtgaagtcaataactgttcatattggggcagaggaaacaaatgcacggccgacgctatttatgtggtcagccatacaggcgaaaccgctgaaaaaagtgaagaaacggattgcaaaacctttaaaccgcaagatttataaaagaaaagagctgttttatacagctctttttcatttccgcgccgcaagcctttttgatatcatccctgaaccggagaaaaccgcgcggatgagaagcatggcagaaaggcggttcggcggcaaatataggcggcggcatgcgatacaatcagtatcgcattcatgacaagcacagaattttttatcaagatgtacatgtttgccccagccggaaagcagcacctgcgatgtaaagccgacactgtttgaagaataaaaaaatcatcgcatttgcctattaaaaaaaccggctgatacagccggttcaaacgggggaaggggtgataatgaacagtttcaatataacagcagcatacaggcagctcaactcgctgaaatgtctttttatcagttgtttgtcgtaaaaacgtccatttgggtgacgtattttctcattatttcctgattgacttcgacacccagtccgggaccgtccgggacagagatgaatccctcttcgatacggatgtcgggagtgacaatatcctcctcccagtatcggtctgatgaggaaatatcacccggtattgtaaattgcggcagcgaagcaagcgcgactgtctgcgctctcgaaatgccggtttcaaacattccgccgcaccaaaccggcatgtgatgctctctgcataagtcatgtatttttaaagcctctgtcaggccccctacacgcgccggttttatgttaatgattttacagctcccaagctcaatcgcccgccttgcatcatcatatgagcatatgctttcatcaaggcataccgcggttctcaagtgtttctgcaggtggcggtgatcgacaatatcgtctgcctgaagcggctgttctatcatcatgagctggaattcatccaactctttcagcctgctgatgtctttcagttcataagccgagttggcatccgccatcagcggtacgttcggaaaacggctgcggatggctctgaccaaatcaacgtcatggcggggctgaatttttatttttatacgttgataaccttcttttacgtattgctcaatttcccgaagcatctcatcagccgaagccagacccaccgccacgccggcgggcactttatctcttttgccccctaaggcttctgcgagagatatcccctttttcttggcatatagatcccacacggctgattcaagccccgcttttgccatgcggtttcctttgaaacgcgcgagactgtcaggcacttctgacggatggaaaaactcgcggcctacgacatttgggatgaaaaaatctctcagcatatgcgcgcatgtctgaatcgtttcttctgtataccacggagaagaaaacgccgatacctccccccagccggttctcccggtttcatcgatcgcttccacgatcaaaaatttacgatcctgcagcgtttcaatacttgttttaaacggttttttcagcctcatacttacatgataaagggtgattttttcaatcttaatcatgacaattctcctttacgaagctcattcagccgatgcctcatcagtttattggacgcgttccgcgggagctcgtcaacctcgaaaaaagcagccggtattttatattttgcaagccgctcacggcaaaaggcggtcagctcctcagaactgacagaagaagtcagcacgagaaaagcatgcggcactttcccccacttcggatcttcggctcccgaaacaccaacctccgctacagccggatgggcaagcagcgccgcttccacttctgccgggtagatgttctctccgcctgaaatgatgaggtccgaccgcctgtccagcacgtataaaaacccttcatcatccaaatagccaagatcgcccgttttaaaccatccattatgaaaagcggcctggttcgcgtcgtcacgatgataataccctttcattacattcgggcctttcaccgtaatttcaccatgttcaaacggcgcacaagggtttccgtccttttcaattctaatttcgcatgaaaacagcggtttaccggccgagccgagcttgtccatgctgaattccggagaaagcgtgacaatctgtgagcaggtttcagtcaagccgtaagattggaataccggaaattgtttcctgcggcattcttcaaggagcggcagcggtgccggacccccgccaagcagaatgcagcgcagtgatgcaggacattgttcagtttccgcaagcaggcccgagagcatggtctgcaccgctgaaatgatcgtgacctgatgggagctgatgctgtccagcacatcagtgacagaaaatttttgatgaagcacgacaggcatgccgtaaatgaccgacttaaacagcgcagacagaccgctgatatgaaacagcggcagcgcaataagccagcggtcccgctctgtgacccccagattcagcgcagacgatacagcgctggaataatgattaccgaaagtctgctgcacccccttcggccttcccgttgttcctgacgtatacataagagtcgccgtatcatcaagtgttacataagcttccggctccatgtcacccgcctcttcagcctgcagctcgtccacatctgcggtggcgaccgcagattcatattcttcgcggcaaaaaccgtcctccgttaataaaagctttgcctgtgaatcttcgagctgaaacaaccgttcctgttttgagagcttcgtattcaacagcacagcttccgcccctaataagaagcaggcgtgaacggcataaaccatttccggtctgttagaaagcaaaatcgcggccctgtctccttttttaagcgagcagtatttggacagccgcgcggccatttgtttagaagcatgatataattctctgaatgtcatctgtttgttttcaaatttgagagcgattctctccggtgtcagctgagccctttgaatgagccaattcggctgttctgtcagcatgttatcatctccgaggtaaaagtactgtttttgaaaagaaaacagcttggaccagagcggctcaagctgtttcgtagtgtcatctgatcacggaaaacgagggaattgaccgaaatcgggactgcgtttctctttaaaggaatcacggccttctttcgcttcgtcagtcgtgtaataaagaagcgttgcatctcctgcaaattgctgaattccggcgaggccgtctgtatcagcgttaaatgccgctttaaggaaacgaagggctgtagggcttttctcaagcatttcttcacaccatttaattgtttcctcttcaagtttctctaatgggacaaccgtattgacaagccccatgtcgagcgcttcctgcgcgttgtattgacggcacaggtaccagatttcacgggctttcttatgtccgacgatacgcgccaggtaacctgagccgtaaccggcatcaaagcttcccactttcgggccggtttgaccgaaaatcgcgttatcggccgcaatcgttaaatcacagacgatatgaagcacatggcctccgccgatggcatagcctgataccatcgctacgaccggtttaggaatcacgcggatcaaacgctgaagatcaagcacattcagacgcgggatctgatcgtctccgacatatccgccgtgaccgcggactttttggtctccgcctgaacagaatgctttatctcccgctcccgcaagaacgatgacaccaatattagagtcatcacgcgcacaagcaaatgcgtcaatcatttctgataccgtcttaggagtaaatgcgttatgtacctccgggcggttaattgttatttttgcaataccgttatacgtctcgtacaggatttcatcgtactgacgttcacttttccattctgcagccattgatatgacctccttcatttttgcctgagtccggccgaaaagctattttctttatgctttacaagccgtataaaaactcacttactatcttaccaaaaattcgcggctgttccacatgtaccgtgtgccccgcctgtttgacaacctctattttacttgatgggagcaggttatgcaccttttgattaatagcgcaaaacttttcatcccattcaccgcatatgagcaggacgggcgccttgatgcggtgtaatgcctcccaccaggaaggctgtgagcccgtccccattccgagcaggcttcctgcaagtccggacggattattcttcagcctgccgacacggatggacgcctttacgctgtccggcagagaaagctgcgtggcaaacaacggaatgctctcccaataatcaacaaacgatgttataccttccctcaatataaagtcagcaagcttccggtctgactgaatccgctttttgcgttcctgaagcgtgctgaggcccggggttgtactttccaaaacaagcgctgacacccgatgcggaaatgcctgtgcaaaggaatacgcaagtcttccccccatagaataaccaataagtttcactttgtgaagttttaattgatcaaaaacggcggcaaggtccgcaacctgccggctcgcactataccttgccgcttgcacaggcgcgtctgtctccccgtgacccaggcagtcaatcatcaccattcgctcgccgggaaacatgccgcgtaaaaacatccatgattctttgctgcccgtaaatccatgcagacaaacaatagcttcagacgattcgtgtccgctatcagcagcacgatagcatacgccgtcagccgttttaactgttacagtttccattcttttttcacttcccgcactgcggcctgcagcagatcacgatggaattgaactcttgatgtccgatctgttttcagctcgattatatgaagtccgggcttgtccgcctgcggctgatacgcatccttaaatgcttcccatgtctcaggacaagtatacgtcccgccgtacagtgcggcggcatgccggaaatcaagacccgtcggcgtaccgaacagttcttcaaaatgagtcttatcagatgcctgcggcaaaaacgagaaaatcccgccgccatcattgtttattaaaataaccgtaagcggaattccaagttttttagccgctaacagcccgtttaaatcatggtaaaacgataaatctccaatgacaagcgtgacaggagcttttgtaccttcacacagccccatagccgaggagacaactccgtcaatgccgttagcaccgcggttggcatagacacggaaggaacgatcttgtttttcaaagaaagtatccacgtcgcggatcggcatgctgttgccgacaaaaatcgaactgccttcagggacaaggtgctgaagctgacgatatacatttccttcaaatgataaatcatccatgctcgcggcctgtaaatgactccggaaccgcgcattgacaaactgccatttctcaagccatccggacggccgttttccggtttcagctgaacggaccgcttccaaaaacaccgacggatggcaatgaatcatatgcgcgccggcctgggtgggatctctccatcctccgtcttcatcgacgataaactgctcaatggcaggatcatctctgagccataaaaagagcggtttggaaaccggcatcgggccgaagcggatcacagcctcagggcgcagcgcctcttttatttcttcatcttttaagaacgagtcataagcatcaataatcagcgtcttatcatgctccccgtttcggaggtttgaaagcggatcagccaaaatcgggaactgaagcatctcggcaagcgcgatgatttgctgcttttctgcttcaccgtgaatttcgccgcagacgatcatacctctttcggtacccgcgagacgctctgtaatatgacagagcgcgtcttgatcagctgactgcatccctgttgtgactgagacgtgcttcccctttctcattctttcaaaaggtccggctgataaatccggcatcaaaggctctctgagcggcacattgatatggactggccccatcgggcgcttcccggcttcacttacggctctgccggccaatgttctgatatagctcagcatttgaggattttcctcaggcagagccgagtctgtgaaaaacttaacaaagttaccgaacagaaaatgctggttaatcgcctgaggcgcccccacttccctcaattcatgaggccggtcagcagtcaggacaataagaggcactcttgaataatgagcttcaatcacggccggatagaagttagccgctgccgttcctgacgtacaaatcagcatgaccggacgctggcgggcttttgcaagaccgagtgcgaaaaaacctgcggatcgttcatcaatctgtatatggacttgaatatccgggtgggccgccgccaaaaccgccaggggagttgacctcgatcccgggcaaacaaccgcgtcggtgacaccagatagagcgaattcatcaataaaacttccgatataatgtgtaatcgggtttgtcaaagcctttcacctcctaaagcagagatcatcggctttagtttaatttgtgtttcttcatattctgattgcggatctgaatcttcaacaataccgcagcctgcgaaaagccgcgcacttttgccttcaatcagccctgatcggatagccacgacaaattctccgttttccctgccgtccatccagccgatcggagccgcgtaccatccgcgtgtcatcggttcaatatcagcgataacttcaacagctttctgctggggagctccgcccaatgccggagtgggatgcagcttttcaattaaatcaaacagcgaagcggaggttttaagatggcctgtgatcggcgtatatagatgctgaacactttttgttttatataattgcggacctgcaggctttttcacatcgctgcagctcgccaagaaagaatcgtgtatcatctgaaccacaaaatcatgttccgcaagatttttttcgtcatgcagcagctctttgccgagacggtcatcttcttgttgattttctccgcgcttaattgaacctgccagacaggtggacataacgtctttgccggattttttgatcagccgttccggtgaagcgccgacaaagcatttatttccctgctcaatcgcaaaaacatagcttgtcgtttggtccgtcaaaagcttgcggacaacgctctccgccggaataggcccatcatatgacaaaacgacttcccttgccagcacgactttatcatattgatttgccttcatatcatttgttgctgttttaatggcctcaagccagttttccacatcaagttcttccgcttttgttaaaacaggatattcttcatactgaattgaagaaactgcaaaagcttctgaaaaagatttcagacgtttcagcgtatcttctgcctgattaccgtctgccgcccattgattgacggttaaataatcaccatctgccgtctttgtcagcatgagtgaggggataaagaacagcccttcttcgaacccgttccattcgtctcctctctcttcagcgggattaaatgaaaaaccgccgaataagacagggccgaccgcggtatgcgccgcctcttcttcttcatgaatatgaaaagccgtctttttaaagcgctcccattgttcaaaaacgtcgtgataacgttttccatttttttcattcgattggaacagcgcttctgtgccaagaccgactattgttaattcactaccgggttctgaccaaaaaaatcgtttgcctttatatttttttgctccgtctttgaaaaatgatagagggtctaaagacgcaatacgtcttgaatagctcaataagacagcatggttgacttgtttggctttatgtaatgcatgatctgcttcctctcggaacgtatgctgcaccgttgtcaccatgagacattcctccataatccgttaaatgcttttaatacaatacacctgtgatgaatttgtgtcaaacacacagatttgagcacgacaaaatgcccgcatttcttattataaacctttttgcgcaaatgaataaagaaacaaacttgaattttctttccccactctcggcaatcactgtatccttttacttccccgtgggaaaatgactatttttatccaccatttttctgcgcaaaaacgttcatactaacagtaagcatcacatagaaacgagggattgatgtgcttacaaacgaacagatcacacacttaaaaaaagaattggaagaagccagagatgatattttaagccgctttaaagaaaatgatcaatttcagttaactgatgaattcccgtatcaatcatccggcgaattgtcttcctatgacaatcatcccggcgatcaggcgaccgaattatacgagcgggaaaaagacctggctctgctcgaccatgaacgggagcaccttcgcgatattgattactctctgaaacaaattgaaaacggcacatacggcacatgtgaagtcagcggcaaggacattccttatgacagactcgaagctctgccgacggctacgacattggcggaatattcctcgcaggatgccgtttccaaagacaggccgattgaagaggaaacaccgttcggacagtttgaatttgatgatgatgaatcaatccgggcggcttacgatagtgaagatgcttatcaggatgttgaggaatacggaaactcagaaacgcctcaggatttagaagatccgccgctcagctatggggatatgacaatgaactcagaagaaaacatcggctatgctgaggattatgaaaactttatcgcgacagatattaccggaaaaaacatttccgtgtatccaagcaaagcacacgaaaaatatgagcaggaactggacgaagaaggaattatgacgacctttggcgatcttcatgctgattaaaaccccggcctgccggggtttttgaatacaaataattggtttgctgcattttcacactgaaaactcatacacttaatggtgcatggatctttaaaaggcttgatctttccaaaagagggaactaacgtattgacattgaatggcggagggaacaaatgaaaaagaagtatatcggtgcaattattgtatttatcattacatatgtcttgttttctttagcagggtttctctttcccatcgaccgggaatggtacgacgcgctgcaaaaacctgactggacgccgagcggatcagtgatcggcatcatatgggcggttttgtttgcgcttatttcgctctcagcagccttgatatacgcaaggttttcatgtaaagaatccaaagctttttgggtgatgctcctcatcaattatatcgtgaatcaaggattcagctattttcaattcacacagaaaaatttgcttgctgcatctatcgattgtctgcttgtggctgtgacaacactcattctgttgctcattgccggtaaatacagtaaagcttcagcctggcttctggttccttatttattatggagcgcttttgccacatacctgtcttttaccatttacgctatgaacgcataataaaaaaaccttgcatactatgcaaggtttttttaatgacccgtacgggattcgaacccgtgttaccgccgtgaaagggcggtgtcttaaccgcttgaccaacgggccttatggcggagaaggagggatttgaaccctcgcgccgcttacacgacctacacccttagcaggggcgcctcttcagccacttgagtacttctccgtatggctccacaggcaggattcgaacctgcgaccgatcggttaacagccgatagctctaccactgagctactgtggaaaaatcatcatggtgggcctgagtggactcgaaccaccgacctcacgcttatcaggcgtgcgctctaaccagctgagctacaggcccatgacaatataaaaatggagcgggtgatgggaatcgaacccacgacatcagcttggaaggctgaggttttaccactaaactacacccgcatgttgtttggggcgattgatgggaatcgaacccacgagtgccagagccacaatctggtgcgttaaccacttcgccacaaccgccaaaacaatattaaattaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccatttttttggttgcgggggcaggatttgaacctgcgaccttcgggttatgagcccgacgagctaccgaactgctccaccccgcgatgataattaaattagatatggcggaggaagagggattcgaacccccgcgggctttgacacccctgtcggttttcaagaccgatcccttcagccagacttgggtattcctccgtataagtggtggaccttgtaggactcgaacctacgaccggacggttatgagccgtctgctctaaccaactgagctaaaggtccaatggtagcggcggaggggatcgaacccccgacctcacgggtatgaaccgtacgctctagccagctgagctacaccgccaaaaacaattaaaatcaagtggagcctagcgggatcgaaccgctgacctcctgcgtgcaaagcaggcgctctcccagctgagctaaggccccaaaatggtcgggaagacaggattcgaacctgcgaccccatggtcccaaaccatgtgctctaccaagctgagctacttcccgtttttcaaaagtatgtatggcgcgcccgagaggagtcgaacccctaaccttttgatccgtagtcaaacgctctatccaattgagctacgggcgcaacaataagtgccgagggccggacttgaaccggcacggtagtcacctaccgcaggattttaagtcctgtgtgtctgccaattccaccaccccggcatggatggtatagtatagttggagcggaagacgggattcgaacccgcgacccccaccttggcaaggtgatgttctaccactgaactacttccgcgtttggcaatgcggatgaagggacttgaacccccacgtctgtaaagacactagagcctgattctagcgcgtctgccaattccgccacatccgcaagaaaaatatggtgagccatgaaggactcgaaccttcgaccctctgattaaaagtcagatgctctaccaactgagctaatggctcttattacaagagacttatatagtataacatataaaagtggtgccggcaagaggacttgaacccccaacctactgattacaagtcagttgctctaccaattgagctacaccggcctaatacgccaacttatgtatgatatgaatggtggaggatgacgggctcgaaccgccgaccctctgcttgtaaggcagatgctctcccagctgagctaatcctccgtatattacacttacgtgtaatggcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgttgccttggtgagccgttacctcaccaactagctaatgcgccgcgggtccatctgtaagtggtagccgaagccaccttttatgtctgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaatggatcacagactaagttcactgcatcctgcagtaacgtctgtgtgatctgcatcgtgcagaccttagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataacacccttttgaaaatatgacaatagttttttaaaaaaatcattaattattttctttcataccttatttcagtttctcttctatagaaagataagctgtcttgtggtttggcctattttcttgtatagtaagattgaactaaatacttgatgaccacaaggggagcattaaagctgagagtgaacgttttgttctgaccctttgaacctgttagttaacgctggcgtagggatgtggcaaagccaaatgatttgcagtttatgtaagcagcgcgcggaccttttcccatccttccccgcgctgcttttttgtttatccttgatacggttgtctgaccagggggaaaactatgaatcattcaacacagcttgtgcgcttaattgaaatagcgattatgaccggggcggctgtcattctggacattgtctcaggtatgtttctccggatgccccaaggcggttcggtctctattatgatgattccgatttttttgatttcattccgctggggagtgaaggccgggcttacgacaggctttttaacagggattgtccagatcgccatcggcaatttgtttttgcagcacccggtgcagctatttctcgattacatcgcggcatttgcagttctcggtttcagcggcttgtttgcttccggtgtacgagcatcggcattgaataaaaaaagaggctctttaacgatgtatgttataggcggtgttttcatcggcagtgcactgcgctatgcggcgcatgtggtctccggagctgtctttttcggaagctatgctccgaagggtacgccggtctggatttattcatccgtctataacgcgacttacatgattccttcttttatcctttcagccattgtccttatcttattattcatgactgcgccgcggcttcttgaagctaagcggacgaactgaaacagcaggcggtttacgcctgctgtttttttattccgggctgtgccgttcgttagaatcactcagttcttttgtaagttcatttatgctttgttttatgtttcctttgcctgaaaaattctcaatcagctcttttacattgattccggaagatgcttttaagctttcctggagaccggccattaaattggttgcgtagcctgtgactttattggctccgccgttttcaccgcttcctcccgtatccacgacggtaattttatcaatgtttgaaagaggcgctgagacttgttttgcgtattcaggcagcattttcacaatcatatcaaggattgcagcctgcccgtatttttcgaatgcgtcggcgattttttctttagcttccgcttctgcgagacctttcaggcggatgacttccgcttcggtttctcctctcgccttttcagcctccgctttagcaagaccgtcaattctcacgcgttccgcttccgccttggccatcgcttcgatgctgtactgctcggcatccgcttctgcgagctgcttcgcttttgcggccgcggccgcttgttccaccgagtaacggtcagcatcggcttttttcttcacttcagagtcatattggcgctcacggcgcagaatttctttttcctccaattcaatctgcttttgccgctcaataattttaatttgcatttcctgctctgtcacctgctggcgcgcttttgcggtttcaagatcatatgcctggtcggcattagcttttgctgtatcctgctctcttctgtattccgccattttcagctgattgattttttccgcttcagctatttccgtcgcccgctccagctctgatttttttgcgtctttatcagcggccgcgcgtttaatcctcgtctctttatccgcttctgccgtggcaatgtccgcatcccgcttgacttgggcgattctcggcttacctaatgattcaagatagccgtttttatcccggacgtctttaatcgtaaaagaaacgatcatcagccccattttagcaagatcctgagacgcgacacgctggacttcctgagaaaacttttccctgtttttataaatctcttcaacggtcatggagccgaggatggagcgcagatggccttccagcacctctcgcgcctcctgctcacggtcgtccttggatttccccaaaaattgttcagctgctgtggcgatttcaccgatggagcctccgattttaataatggcggttccgtcggccattaccggcacgccttgctctgtatagacttcaggtgtagagacatcaagtttgcttgacagtaaactgagaggttctgcctgctggaataccgggagcacgaacgttcccccgccccggacgattttcagacgatttccgccttcatcaatgtggacgttcttatttcccaaataacttccggtcacgataagggcttcatccggccccgctgtccggtacttcgtaataaatacagcaataagtgcgatgagtaaaaagaatacgattccgataacaatgataatcggcatagtcataacagttcccccttagatatcagattggttcatgcggcgtcacaaaaagcactccgtctttcacgtcaatcactaatacggccgttccgtacttgatctgttcttgatcaaagctgacggctgatttagaaatggcgccccctattccctctatgatcacttccccatagccgtctttcgggacggaagtaatgaccctgccgactctgccctttaaatctgtctcccgatatgagagcgattcttccgctgatgaaagcgggacaaggacgaagaaatgaagcaggctgaccaaaagaaccgaaagaacaaatgaaattaacgcaatgacaggacttgatagcggagcggcgatttcgccgatataacctgaggctgaaaagattgttaaaaaagacagaatcaatgcagggtttaaaaatgaaacaggaatggcttccgagaggccgtgaaacacatcttgaaaaaacagaatcaaaagcgtgagacttcccgaaataatcaatgtgtaaagatagaccgtttcaagcggcagatgaaatatgtccacattctatcctcctttcggcttagtgtcggagtgttactttatatacggatgtaaaggcaaatggtttcaattttctgataaggaaggctgattacatgattatccaatccggatatgatatgtttactctaaaggaggagataggatgagcatttttaatgaagccagacagcagacctgggaagtactgaaaggactctctgatgaggaattcaatcgaaagcccgcggctgatgagtggagcgtgcgggaagtccttgaccatttaaagaaaattgacgaaacagcgcagacccttttatcaaagcaggcaaaagacgcaccgtttaaaaaaatcgaagacaaaccgatggagtttatagaggacagatcaaataaacggccggcgccgtcacacctcgaacctgagcaaaaccgaatatcagtcattgaggcaaaacaagaattagatacggcaagacagcagctgaccgcagttatttcatcattaaacgaggaagactttgaacgtgtgcttccgcatcctgtttttcaagaactgacgatccgccagtggattgattttatcggccatcatgaaaagcgtcacatcaatcaaatagaagaaatcaaacaaaaaatcgagaaggtctgactcagaccttctcgatttttttcttggcgcgtttcggttcataagaatggatggtgaccgcatcgcccgtgcatatatcacccgggcgttcaacaatacagacaattcctcttctgcccatcgcgtgcctcacaaacgccgcgggagttttggctgatccggataaaaggattgaataacttctcccggctgaatgcacggatcattttctccttcacacaacagagacgcaccgcttggaaatatcattctgcttccttctttaagcggcgtcagcgcagaaaaaccactgattgcaatgttagcgccgagccattcgggaaagatatgagaaatccccatcttctccgcaatgtcatcacattcctccatggacacgattgaaatttgtctccggttaaaaatttccgttcctctttcatacatcggctcacgcgcgccggccttttttgtcagtccgaaatgcaggtcaccgggaaacccgccgtattccgcgcgaagcttgtccatctttttagtaacaaattgttcggtatccgctatatatacgccttccgtctttgctgttatgcgtttccacatcagccaccaccgcctttttcttgacattatccttaaaaaaccccgctctgtaaaggagcggggttcatttattataccgttttcggcgttaagtcaaagcaacgtttgtaaatccagttgtatgctttctcattcaaatctcttggatttccgaatgtttgcggatctttcatggcttcttttgataaccgttcaatcatgtccggagacacaccttgttcttctaaactcggcacctctaaatcttttacaagatcatacatccagttgacggacgcttttgccgcttcttcagttgtcatgttgcttgtatcgattccgaatgctttggcgatgcgggcgaatttttccggatagcctttccagttgtattccattaccggtcccatcatagctgcgacgcattgtccgtgagcgacagggataatgccgccgagcgtctggctcatcgcatgcgccgcgcctgctgattcactgccgtatgaaaggccggcaagcatcgccgcctgcgccatgccgtatcttgcttccaaatcctctccgtccgcaaacgcgcgcttaatataatgcgccgcatattcaatggccattaaagcgacggcatcagtgatcggctgcgcgaatttcatcgtatagcactcgatggcgtgcgcaagtgcatcaatacctgtcatggccgtcacatgcggaggcatggacgtgtgcagctcagggtcaatgaccgttagatgcgcagcgataagcggtccgcccgtattgaatttaaattctctttcctcatctgtaatgaccgcccattgtgtgacctctgaacctgttcccgcagtcgtcgggatcgttgtcagcggaggaatgcggttttccagcggctttttgccttccgcggcttcataatcaagcacgcttccttcgtgtgtcgcttctaccccgatcgctttcgccgtatccatggagcttccgccgccgacagccacaagaccgttgcagttttcttttttatacagttctgatccttcgttcacaagacgtacaggcgggttcggctccactttgttaaacaggacgacttcgatgcccgcttcctgcaaagattcaatgaccgggtttgccactcccgcgttataaattcccgggtctgttacgagcagcgcttttgtgacgccaagcgctctgacttcacttcccgcgtgctgaatcgcgccgattccgtgtttaatgactgtcgggatttcgaatgtatggaatttatgcatgctttctactttcatatttaatgtcatatttatctcctcctaattatgcttgaaaccagttcacagccgcaggtttcgtgttgcggtaaatatgtttgatttccgtgtattcttccaggccgattttaccgagctcacggccgaagcccgattgtttgtacccgccccatggcgcttgcgcgaaatacgggtggaaatcattgatccataccgttcccatccgcagtttggcggctacgcgttcgcatttttcaatatcctttgaccataccgctccggccagcccgtaaatggtatcgttggcaagtctgatcacttcttcttcagaagaaaatgactcaactgttaaaacggggccgaagatctcctcttggactatccgcatatcagacttgcagtttgagaaaatagtaggttcatagaagaaaccgttttgaagggcgggatcatcaggacgtttgccgcctgtttccagttttgccccttcttcgataccgatttctacgtatttttcgactttggcccgatgctcggcggaaatcagcggaccgctttccgtatcttcatgaaaaccgtttcctaatttgatgcgtttcgtgcgcttgatcagctcggctaaaaattcatcatgaatggcttcgtccaccaaaagacgggaccctgccgaacaaacttggccggcatggaaaaacacggcgttcagcgcttgatctgcagctgtttcgagatctgcatcttgaaatacgatattcggattcttgccgccaagctccagggcaatctttttcacgttgccgcttgccgcctgcatgatttttttgcctgtttcaattccgcccgtaaaagagaccaaatcgacgtcaaggtttctcgccagctcgtcgccgacagaagcgcccggccccagcacgagattggcggcccctttcggaataccggcttcttctattaattgaaagactttaatggttgtcagcggagtaatctcgctcggctttaaaacgatcgtgtttccggccgcaagagcgggagcgattttccagctcgcctgaaggagcggatagttccacggcgtaatttgtccgcatacgccaattggctctctgacgattttacttactgaatcgggaatcggagatgaaatgacttcgcctccgtctttatccgccaaaccggcataatattgaaatacatttgcgatatcatccatatcggctttactttcttcaatcgtttttcctgtgtcaagcgattccagctcagctaattcgttcagatcgcgtctgattaattccgcaattttcagaacaaattgtccgcgctcgagcccggaaagcaccggccactccccttcatcaaatgcttttctggctgcggcgatggctttcaccgcatcatcccggtctccttcgcataccgttgcaatttcttcttgattaaatggattaatgatacggcgggtctgttttttttctgcactgatccattcgccgccgatataaagcgttttgctcataagagtcctccttaccgataagtaagtttgttaaataaaaatttaatgtttttaacaatgttaatttaacacatgtttttttgcctgtcaaaacccggtcagtccgtttagattttgacattttgtcatgattcgttaagattaagaacataaagaaatgacttaacaaatttaaacttcaagaggaaaagagggacagtatggatgagaatccagaattcacagctatagaacaagccagggatcttgtcattgattccattgcagagacgatggatctttacggaatcacccggagtgtcgggattttatacggaacaatgtatatgagggatgaaatgacgcttgacgaaatgcgtgaggaactgcagatgagcaaaccgagtatgagcacaggcgtcaaaaagctgcaggatttaaatgtggtcaaaaaaacctttcaccgcggcacacggaagcatacgtttgtagcggaaaaggatttctttacgtttttcacgaatttctttccgccgaaatgggaccgtgaagttcaggtgaatttgtccgccatcgtacaggcccaggcggatttgcagtccgttttgctggccgaggaaggcagcgcggaattacaggaagaagcgcggcagttatatgatcagcttgaaagctcgaaagcttattatcattggctgaagcggctcgccgactcggttcagagcggggagatttttaaatttattccgatagaaacagacgaaaaaaacgcctgattttgattcaggcgttttttgtcgtgatttgattatttttgagaaaatataggaacataaccccatttacttccattaaaattgatggtaaatttttataggtatggtcgttcttttttaagaacaatcagcaaatttttttagggggatttatgaaaatgaaacagaaatttttctcaactgtcatggcaagtttattcggcctggttttgcttctttctctgccgacagcgtcattcgccgctgagtcaggctcaaccgttcacgagccggaaatgtccgcgaaagcgactgctaccttatttgcaaaatatacaggtgccagccagcaggaatggtcattttctgatatcgaattgacgtaccgtccgaacacgatcctgagcttaggcgttatggaatttacccttcctagcggatttgcggctacaacaaaagatacagtcaacggacacgctttgcgtgaaagacagattctgaataacggcaaaacagtcagacttccgttaaacattgatttgctcggcgcagcggaatttaagctttctcttaataataaaacattgcctgctgcaggtacatataagttccgtgcagaaaataaatcattaagcatcggctctaaattctatgctgaggacacaattgttgttcaaaaacgcagcacaccgccgacacagccttgcaactgcaaataattgcgaaaaacggaccggcacaagctcatcgcttgtcagccggtctttttttgtgctgttttctttcttccggccctcgcattgacaaacccctgaaacaggagtacattcttgtttgttgtatttggagtgacgaaaacagtttcttaaggagttatgaggattgggaaaaatcaaaaataaacaatttgccgtcatcggactcggccgtttcggcggaagcatctgtaaagagctttttaaaatggggcatgaggtgcttgcgatcgatatcagcgaagagcgggtcaacgcatactcctcttatgccacgcatgccgtgcgggcaaattcaacggaagaaagcgagcttcagtcgctcggcatcagaaattttgaatatgtcatcgtagcaatcggcgccaacattcaggcaagcacgctgacgacgctgttattgaaggagctgaacatccctaatatttgggtgaaagcgcaaaactattatcatcacaaagtgcttgaaaagatcggtgctgaccgtattatccatcccgaaaaggatatgggcgtgcggattgcgcaaagcctttcagatgaaaacgtcttaaattacatcgatttgtcagatgaatacagcattgtggagctttcagccacgaaaaagctgcatttaaaatccattcttgatctcggcgtccgggccagattcggctgcaccattctcgccgtgaaacataatggagacattcagctgtccccttctccggagactgtcattcatgaatgtgactgccttgtgctgatggggcataaacgtgatattaaaaggtttgaaactgaaggaatgtaaaaaagccggcaagctgccggctttttttgatgcttatgtttcttcacttaactggacggcggtttggtcaacccagccgatcagctcatctttcacttgaatttggtaccagacggattctccgttttgtttttcagatacgactttaatatgctggccggtaaacttttgcgccgatgccagttttatagaatgccgctcttttgacggcttggaccacacgtcttcaatgacgtggtctttgatggcgcctttcatatcaactgctttaagagaggcattgattttgtcatattcattcaggttataggtttctatgacatctttaattttttcagcatagccggggtctgtggcgtagccggatttttgaagggcagccgccgctgttttataattgtccgcttcaatgacgggcttgtacttctttttattccaagacgttccgttgacaaataatttggcatggtcatccattgattcaaaaaacgtgctgtatttacggaattttgcccgaatcgtttttcgttttcctttttcaaattcatccgttttcatcgtgacgtgttttcctttataatcaccttttacaccgaacaggttgcgcgctttccccgcaagctcactgttcccccagtccgattcgagaatggcctgtgcgagggtgatgctcggaaggacatgatatttctcatataaaatctgagcatgcccggaaaggctgtcaataaagacctgctgctcgtccacctcttcaggcggtttttcttccgtcactatgaatttcgaaaataccattgataccagaaataatccgaatataagagatacagcaaaaaggcacccaagcacccttttggtctttgctttctttttcatatcaaccttcctttaattccggaatcactagatttataattttactggtcattgatgaaaatttcaataaaatagggaaaaagacggagaaagaacacattgtgcaaataaaaaagactcctctttgaggagtctttttttgttatgccatgctcagctgagggccgaacaattcatattgaacagaatcagagtcaaacccgagtgcaagaatcatatctttcatttgcgtcataaactgcgctgacccgcacaagtaacattcagcatcttgattcagatgaagctgctccaagaaggtttgatcaatccggccgctgtaaaaaggcttgtctcctgagcggtcttgttctgccggttcactgtatacataaatgacgttaatattcggatgattctccgcagcttgttcagcctctttgcggaacgcggcgtactctccgtttttcgcggcatgaataaaagtaacggaacgctccggctgtttttcggcggctgttttcagcatgctcatcatcggcgtgattccggaaccggcactgataagaacaaccggtttttcggcagcagacagcttgaaatctccggcgggtgcgctgacttcaagtttatctccctcttgaacttcattgtggagatgagaagaaaccgctccgtcctttttcacagaaatccgatatgcgccttttcgagaagcatcagacagactgtactggcgaatgtgcgtataaggcgaatccgcaatccgcactttaatgctgatatattgtcccgcttcaaatccaggtagcgaagagccgtcactcggtttgatataaaacgatgtgatatctttgctttcttttgttttctgtataaccgtaaattctttatacccctgccatccggcttcattgtacatgtctttttcaatgccgatgaaagcctccgcaataacaccgtaagctttttcccatgcctgcataatctcaggagttgcggcatcctgcagcacatccttaatcgccagaagcagatactttccgacaatcggataatgttccggttttacaccgatgcttgtgtgcttatggccgatctgtctgaccgccggaatgatttgttctaattgatcaatattcgccgcagccgcaatgactgcatttgccaatgctgcgcgctgagtctgtttcttttggttcgtttggttaaacatatttaacagttcgggatgatcttgaaacatcaggttataaaagcgcccggtgatgttttctccatgtgttttcaatacaggtactgtgcttttgatgatgtctattgttctctcatccagcatgttcatcctcaacccttctaaagatgtattttcaatatatctttatagtaagagatatttcgaataaaagatatatctaaaatgaatctttaaaaagtcgtcacaatattgtgttggatttggaatttatggatttcacctccttttttatcacccggtgaaacagggacacatatatttgggaatatacgtttaaagatgaaagcgggggattgcatggtttccgatatcgattacacgtctccgaatacacagttcacttatgatgtgaatgagagccgtttttttacgaaagatgctcggaactttatcaatgtattggggattaaacagttaaacacgcttgaaaatatttcattattagatatctttctgagtaaaacaaatgtgattgaaccgcatacccatcaaaacgccgctgaattggtgtactgtatttcgggttccgcggtggtgtcgatgctgaatccgttcacccagaaaatacgtaattacccgattacccccgggcaagtggcgaatattccgcaggggtggtggcattatgaagtcgccacttcagacaaaacccatcttttagccatatttgacgccccttcgcctgaagtgatatacggctcggatattctccgtctgacgccgcctgagatcatggcgcatacgtactgtttgaatgagcatgagtgggaaaaagccgtttcaccgatccggcaatcaactgtgataggtcccgataaatactgcggacagtctgaaaacacgggtattcatgatatgaataagccttatcagccaaatacgcattatctgaatgatccgtatcggcattatgttcagccgttctatcgggggtattaaatgggaaacggagcggcattcaagctttgacgaaaaaagcccctcattggagaggggctcttgatcattacggtccggttccgcagcttactttgtactcgccttcggacgatttttttgaataacatacgtgcggcgtctgtccggtttcatctttccaattgaaccaatttacataataaaggttcccggcctctccgcctccttcttctttttgaagaatcgcaaagtagctttgatacggatatccttttttataaatgtcatgcctgatggctcctttttctgaagcagacgtgaagatgatgggagaaagagccgggagcgctgttaaaagaagtgccactgccgctgacagagataatataagatagattttctttttcattttctctctttcctttattttgagttgttagaaatgaagcggaacacagaggctgctgcagaggattaaaaacttataaaggtatggagccaaggggctcgcacccctgacctctacgctgccagtgtggagatgcttttctgataggaacagacgttttgtttcaaatcctaatcttttatttggctaaaaatgaataagctggtcccaaaataggataataaattaaaggttaattttccactagacctgccatcaaaacgcccatcacaatcaataataatagtaaaagtaaacaaagtgctaggataacaaaagaaatattctttgcaattcctttaggcgatttgattgctagaatactccccacaacaattcctaggattccaagcgcccaatgaatatgaggcaggaaacacaatgtgaataaaaggatgataagcgacacgatcccaaaatactttctcatttctctcctttctattttccctccattaaattgaaaagaaaattgaacttataaatattgagtgccatattttttaaatattagcagaattatcgttcgagctttatgacgacggatacatacgcgaggttatctgcgcagttcattacgggaccacctacggaaggaatttcgtgtgaagaacttaaagggggatacattattgtatttgattctcttttatccgttgagacttatgaagttgggagatgatcaaatgactgattttgaatgaaaagtgcaccggattatctttaatatgtcccgctttaggaaaaatccctccatggaacaattgaaaagaaaaaacaggtgtttgttttgaagctaatgaagaaactaaaaaagccttttccgaagaaaaggcgtaagctgttcaagtctgaaaacgatccgaagcagtttgaaaggtatcatgtgttttttccactgtgttcacacccaatccgcatactaaagataacgacagacccaaaataatgaagatgctttttttcatactggcactctccttcttaagtttgattacgatcagatgaaacttgatatgatccatcaaatgaaacaaccgaagccgttagaccggcccctgacattaaaacgacagccgatacaatgataaatacgccttttctaaaattcatacaggcattctcccctctgaatttgtttttgcgtttgaatcattttttgatgataaaaataagatttgtcatattgctttgattctgcataaacagcagccgtatcaagagcaatatcttctacatacgaatagtttttatttttctcaaggtaatcaattgtttttttgattcccatttggtctattgcattaatatataaagcctccaaatatttttgcagagattcaaacagcttatccccttgatatatcgctgatgaaagtccctttttgctgatttgaatcgcctcgcttgttttcccttgtttaaatagaagctttgcgtatgtaaacaaggaatgcggaaggttacccaatttatacttttcagatatctccgctgctttttttaagtagatttcagcattactgtattcttctaggtctccgtaattctttcctatgttgtaataagcagaactgagcagcctttcattattgtttacttgtttcgacaactctaaagctttttctaaatgaggcaaacttttttcaaagcgtttaaagtcaacataattcccagagatgacgaatagacattgaattttccggaccttatacaactcatactgatcgtaaatatcgagcgcttgctttacgtgatgcatggagacgtggctttgtttcataccgtaatatgcttcagccagtttaaaatgaaactccgctctctcaatttcatcatgcacatgaacgagttgtttttcagcttctctataaaagccgatcgcctttacatactgcttttgatcaaattcatacatgccgcggaaaaataaagaataatagcacagcaggccggaaattcctttatttgatgcttcgattttttccagcagctcgtcaattgtcggtctcacgcgggtagtcaccggttctaaataatccagcatgagctgatggcggaatttcatgagggtgtagtaaatcagtagatactcgtcttcttccatctcatttatttcttgctccacttccgctttcaaaatctccgcatccggaacactgaactgacgtatcattttgtaccattcattaatcttaacgccaacctccgatgacggtaaaacagaactcacaaggccactcctccttttatataatattctaacatttccataatatgtttggacgaaaaaaaaccgcaatttgtttgcagttgccagattacttattttcacataactgttggaaacgtccattctatttgcgataataaaactaatgtatggggaatataaatgggagggattaaggatgtgtcatttaaaatgagccttactttatcactcaaatgttttaagctgtatgaaaatgtgtactttgggatagcgtttataagtagactctctacaagtctactttatttttttctcataaataaacgaggtgaaaatcaatggatggtgtagaatttttagaaaatatgacacgactcggagtactcattttggtgttctcaggatatgctgtttattggaaattaggtaaaacaaaaagagagcgagggcttacaaaatttgaagcttgtcttaggttctctgtcatgttcggtatattagcttggggggttcgactcttgctttgagtttatggtcataatcttttttgtcgatattttacttatcctgtctaaacagattaaaactagataaatgtacccttatttagaaaaatgtgttaccgtgtagtttcttgtacaagtttctaaaagagaaagttataatgttgaaaagattagtttttctggcgttgaccctacttcttgctattgctacaatagcgccaacagtttcagcagaggaagagaacgggttagatggattaactaaagaacaaattgaaaaattttgaaaagaagttgagtacatctttactaagattgtaatttttgatgaagagacaggctacacagttaatgaggatgagcttgaaaagtctccttataccaaaggtcaaaaagagggtatgatcgctttcgctaaatatatgaataaggaatataagtatgcaagtgtccaaaagaacactgttcaaagatcttgaaaatgctattgtatctctaaaggagcattagataaagttcaaaaggcaattgaaaaaggagattggtggacagtattagaatatctgggcaaattaggtttagcaatttccctatcagcagtatttacattcttcctgttctgcggtgctacaccagcaaagattgctccgcaagaaaattgataaacaacaaagccgcctttagaggcggcttcttcaatcctaattgaaggcgaaaagcaactaaacttcctcaaaataaatttttcgtccccaaattgtccccaattgcttttttgggctattgctctgttcctgacaaataaaaaaacccttatagaataagggtttaaaggtatggagccaagggggctcgaacccctgacctctacgctgccagcgtagcgctctcccagctgagctatggccccgtgctgtaacgtcatgttttattatagacgactcttctatgaatttcaagcagaaaattcagtttgctcatattttcctgagacgtttttcgaacataaaaagaagaccctccgggggcctcttcgtttatcgcacgagcatgattaaaatgatgccgaggatgacacggtaaatggcgaacgggacaagcttaatccggttaatgagccgaagaaaaaatttgacgactaagagggcgacgacaaaggcgcagataaagccgacaagaaaaaacggaatcatgtcataagaaagactgccccagtatttcaccagcttcagaaggcttgcgcccgccataatcggaatggccataataaatgtgaagtctgcggctgcccggtgattcaagccgacaatgacacctccggcaatcgttgagcctgagcgggaaaatccgggccataaggcgagacactggaataatccgacacagaaagcctgtttgtaggtgattctgtccaccgtatcgatcgtttctttccttttattgatccagtccgctataagcataagcacagctccggcaattaatccgtaagcgaccgttctgacggagaataaatagcggtcaatgaaatcctcaaataaaaagccgagcaccgctgccggaacaagaccgacggcgatttgcgcgatggtcagcctgtatcccttctgctgatcgcgcgtgacgttttttttgaggccgagtaaatgtaatatccgatccttaaacacaatggccaccgccagaatcgaaccgagctgaatcaccactttgaaggaattggcggcttccggattcatcaggcttccggatttcagccaaatgtcatccgctatgatcatatgtcccgtggaagaaaccggcgcgtattccgtcagcccttccacgattcccaaaacggctgctgtgaacatctcccatagtgtcatcccattcttcccttcattcatcatttacaaaagagaagctctcctttgaaggaaagcctgtcttataataaatatcatgtccgttccgattttatgacttcgatacagcatcatttttttcttcttcatataaatgcgagcgcattttgaaccaatcaaacagatgggtcgtgaccactttgatgaccgcataccccgggatggctaaaataatgccgacaaccccgaacagctttccggcggttaaaagaacaaagatgatggtaatcgggtgaatgtgaagatttttccccatgatctgcggcgaaattaatttaccttccacgagctggacaacggtccagacaatcgcaagtttcagcagcataagaggcgaagtgaccaacgcgataataatcgccggcgtgatggcaatggtcggccctaaatacggaacaacgctcgtacaagcggcaatgaccgcaagcagggaagcataatcaagtccgataatcagatagccgataaataataaaaacccgatacagaagctgacgatgacctgtcctctgatataggagcttaatctgtggttcatttcactaagcatcgtatacgtttgttctttcagacgggtgggcacaaactttaagatataaatcggcagttttttgccgtctttcagcaaatagaacagaataaacggcacggtcacaatcgaaataatcacttcagtcagcgcgccgataaaattcccgactccggtaaatgtactgtttgcaattgtcgccgcctgcgccgatactttattagcgagatcggaaatgttgatattcatcgtcttttgcgcctgatttacaaaatcgcttccgatcaggcttttcgtctgatcttcaacgatgtccacatatttcggcaggttgtcgatcaggctcatgatctgttcctttaaaaacggaataattgaaacgaccgtaatcgaaatcagccctataataatgaggtaaaggagcaggatggaatagactcttttcactcttattttttccaatatatctacgatcggattaagcagataataaacaattcctgtcaaaatgacggggagcgcaatcgttttgagcaggacgataatgggtgtgaaaataaatgatgtcttcataaagacaaggatattgagaccgatgagcagcaatacaagcaaaaacaagacaaatttattgtctaagaaaaactgtttaaatctgccgccccatgtttgcaatgtttccactattgttcctccatcatatgtattttacttaaattgtacactatcgttcctgtaatgaaaaataataaccggtctctatgggaatttttcctatccctttagctggcagccttttttccatttatgtttctcagaaaaaaagctataatgtaagccaatacatagaaggagcgatagcaatgattcgatttgcaacagtcggtacgaattggattacagaacgatttctggaagcggcttctgctattgatgattttcaattaacggcggtttattccagaactgaagaacgtgcggcggaattcgcaggcaaacacggcgctgctcattatttcaccagcctgaaagaaatggcggaaagcaaagcctatgacgcggtgtatctcgccagcccgaatgcatttcacaaagagcaggcggtcctttttatggaacacggcaagcatgtactgtgcgaaaaaccgtttgcgtctaacgcaagggaaacggatgaaatgattcacgcagccaaaacgaacggcgttctcttgatggaagccatgaaaacgacgttcctgccgaacttcagcatgcttcaacaccacttacataaaatcggacccgtcaggagattcacggcaagctactgccaatattcatcacgatatgatgcatataaaaacggtacggtgcttaacgcgtttaagcctgaattatcgaacggttcgttaatggacatcggcgtgtactgcatttatccggccgtcgtcctgttcggcaaaccgaaaaacgtcattgcgaccggtcataaactagcatccggcgttgacggcgaaggcacggtcattctgtcatacgacggatttgaagcggtgctgatgcattcgaaaatctcaaattcgtttgccccggcggaaattcagggtgaagacggcacgatcgttctggacagcattcacggaccggaacgggcggaaatccgctatcgtgacggccggacggaagacatttcagtccctgatctgaaaccttcgatgtactacgaaacggctgaattcatcaatcttcttcgaaacggacagcgggagtcttccgaaaatacatttgaacgttctttcattacggcgagcattatggaagaagcgagaaaacaaatcggaatcgtctttcccgccgatcaaaactaaaaacatccgcccggattcgggcggatgttttttatttggacgctaacaggtcagcaaacgcttttgcatactgcggaaggtcgggcgggcggcggcttgatacaatgtggccgtcagttacgacagcttcatccagccactgtgcccctgcatttgtcatgtcgtctttgatgccgggcgtgctcgttactttttttcctgcaagaattccggcagatataagcacccagcccgcatggcagatctggccgatcggctttttctgctcgttcatcgtacggatgatgtccaaaacttcgggatatcttcgcagtttgtcaggagcccagccgccaggcacgagcacggcatcatactcctgaataatcaggctcttaaaatcgtaatccgccgtcgcgggcacgccgtattttcctttgtatgaacggcccgcttcttctcctattaaatgaacgatcgcgccttcctctctcagccggtagacgggataccaaagctctaagtcttcaaaatcgtcactgacaagcgctatgacttttttgccttctaatctcatcactgccactcccttcttttatattagtgtatcgcttttttcagatgaggaaaagaaacagctcgttacagctgttcttcgtcttcagactgaatcgtaaatttccgtgtgacctgctgcagttcttcagccatatgcgcaagcgtttcggcggatgaactgatttcttccatggaggccagctgctcttcagctgaggcggcgatgtcttgaatgccggcggacccttctttggcgactgaggtaatgtcctccactgcgtttgtcacattttgcgacccggctgcaagctgctcaagcgttccgttcatatgctgcaaggcgcctgaaatctgagtcgtcatttctgagatttttttgaagctttcggccgtttgatccgtaatatcgaggccttccttcacatcttgattcaccgcttggaatacggaaagcgatgtggcgatttctttgacgatttcctgaatcagcgtttcgatttccttcgcggagccggcggattgtacggcaagctttctcacttcttccgcaacgacggagaagccccgcccgtattcgcctgctctggccgcttcaatggccgcgtttaaggcaagcagatttgtttgatcggcaatgccgttaatgacgttcagaatgctcttaatgtcgtgcgacttcgtttccagcccttttacgaccgcttccgcctgctgtacggaacgatcaattgttttcatctggccgaccgttttcgccactaattcttctccgcttccggccgtttcagaggtttggatggcggattcagtgatttccgccgatacattcgccgtctcggcaatgccggcattcattttggaaagatgatcagcactttcttccaatttctcgctttgtgattcgtttccgtttgagaattgttcaatcgccagagtaatatgctctgtcgccttgcttgtctgtccggcggatgccgtcagctcttcagatgaagaagcgacatgttcgacggatgattggatgacgccgatgacagaccggagtgatgccgacatctcattgaagctttggctgagctgcccgaattcattttttgacttgatgtcaatgacttccgttaaatcgccgtcactgattttagctgatgtcgagacaagttttttgagcggttttgcaatcgagcgaatgataaaaaagattaaaataccgccgacgataagagaaaccgccaggatgatcagcgccattttcatgacaggcgaggctgcgtcatggatctcactgacaaaaaatgtgccggcgattttccagcccgtcagtttgtttgtcgtgaaggccattttcttctgctgtccttcaaacatgtattcaaacgatccgcttgatttggaaaatacctctttcgtccactctccggagccttccgttcccgcttttatagtcggatgggcgatgtattttttatcccccgttgtaatgaaggcaaatcctttatgaccgatctggacgcgttcggaagcgttcagcaggtcgcccagattaatatcaagcgccacaacgcctgatcggtcttttgtctgctgggcaatcgtaacgaccgtctgtccggttgcagcgtctttataaggctcggtaaacaccggctgtccgcttttttcaaccgcctttgtataccactcgcgcgtgagcggattataatcggacggcatgtcagcggacggatatttcacaaacgctttgtcgcgagacgcggcgtaaattgacgcgacatcgccatttacggtgacatactgcttcatattgtcgagcagtaccgatttatttttcgtgttcagtttttcctttgtgattgattcgctgtagtagtcaatcgctttcagcttaccctcaagcatgttttccagcacgctgttcagttcactgacatttccctgggcgctgtgggtcagttcgctttctaatgtactccccgccgtttggtagctgaagtaggcgagtatgccgaccggaagcaccaatacggctaaaaatgccgcgatcagcggcttgctgatggatggctgtttgatccaatgtatcagttgtttcattttttcagtctccttctttgaaaagctaaatctaatatcgtcagataggacaaaagatttattaaaaaaactaaaaaaaacacccaaacagcacatttgggtattctatgatctattaatctattttaaatcgtttcgtcatatcacgtaattcttccgccatttgggataacgtttccgaagacgaactgatttcttccattgaagccagctgttcttcggcagaggccgcgatatcctgaatgctggcggagctttcttttgcgatggacgcgatttgctcagaagctcctgaaatctgctgtgatcctgctgtcagctgttctaccgtcgcattcatattttgaatttctccggcgatctggttcgtcatttcagaaatccgtttgaagctcgtttcggtctgattcgtaatatccagtccgctctccacctctttgttgacggattggaacatgccgagagatgtattgatttcgttgacgatttctataattaagctttcgatttctttcgctgaatcggcagactggaccgcaagttttctgacctcttcggcgacgactgagaagccccggccgtattcacccgcacgcgcggcttcaattgccgcattcagcgcaagaaggtttgtctgatcagcgattccgttaatgacaccgagaatgtttgtaatgtcttttgattttgtctcaagtccgcgcaccacttgttcagcttctttcactgaccggtcaatgacgttcatttggccgaccgtctggtggacgagctttccgcctgaattggcgacttccgctgatgtgacggaggattcggtaatgacggcagatgctttcgccatatctttaagcccgctgttcatttgataaatatgttccgccgcgctttcgatattttcactttggctttcatttccgttagaaaattgttcgatcgccagtgtgatatgttccgttgccttgcttgtctgctccgctgaagccgtcagctcctctgaggaagatgcgacgttattcacggaatcctggatggcatggatgagagacctgagtgaatcggccatattgttaaagcttttgccaagctcgcctaattcatcttttgactgaatctcgatcgtttctgttaagtcgccttcactgatttgtttcgatgatgtcacaagctgcttgagcggttttgtgattgaacggataatcagcaccatgacgatggttccgatgacaatcgctaatacgagaacgagcagggacagatgaaggatcggcagggccgcttcatgaatttcgtccagatacattgttccggtaatcttccagcctgtcagcccgttcgtatcataagccattttcttttcctggccgtcgtatttgtattgaaaatcaccttttttgctggtgaacagctgttcagcccactccccgtttaatactgtgcctgacgcacggttcgggtgggcgaccacttttttgtctttcgtcaggataaaagcgtagcctgattttccgatgttcactttctttgtcgttttcagaagctcatcgattttcatattgatggcgacgacccctgagccgtctttcgtctgctgaacgaccgtcacgaccatcgtattggtggaagccgtgcggtaaggatctgttacaacaactttccccttattttccacggcctttttataccagtctctttcaagcggattatatcctttaggcatctgcagatccggataccgtgtgaaatgtccttccgtgtcactcgtatagatggattccacgtctttattaatcttcatgtactctgtgaatttatcggtaatttgcgattggtttttcggcttgtaccgatcctttgtgagccagtcgctgaaatatgccgttccgtcttccttttggctgatgcttgtgttgatcatatcgttaatctgctgcacattatctagtgcgcttcccatcatctgcctgtcaagcgtgcttaccgccgattgataggcgataaaagccagcgttgaaataggaagaatgagaatggccaaaaaagaaatgagcagttttcttgtaagcgatctctgcttgatgatttgcacaatttttttcatctgctatatctcctcttgcgtgtttacccttcatatcggcaattatgggtaaatatacacatccaaaaagaagaaatataacgaaacatactttttacctattgcaaaattagtcttttagacttaattaagagtttatcttaaaacgctttgtcagttcgcgtaattcttccgccattttttccagcgtgacggctgaggaactgatctcctccatggacgcaagctgctcttcagctgaagccgcgatgtcctgaatgccggccgcgctttgtctggagactgccgcgatatcctctgaagcgtttgatacttcctgagatccggcagaaagctgttccacggttgcattcatattttgcagttcaccggcaatctgatttgttttagcggaaatgtcccggaagcttttttccgtttcgtccgttaactgaagtccgcttttcacctcgtgattgacggattccagcattccgagcgaagtatgaatttctttgacgatttcatgaattaaggattcgatttctttcgctgaatctgcggattggacggcaagctttctcacttcttcggcaacgactgaaaaaccgcgtccgtattctcccgctcttgccgcttcaatggctgcatttaaagcaaggagattcgtttgatcggcaatgccgttaatgacgcgcaaaatgctggtgatgtcctgcgatttgagttcaagcccttgtacgacttgctccgctttacttacggattggtcaatggcgcccatctggccggctgttttcttgacaagccgctcaccggcgccggatatctccgccgattctattgacgtttccgtcaccacggctgccgcttccgccagatcgctgagcccgtctttcatctcattcacttgtgctgtcgctttatcaatactctcactttggtcttccgttccattagaaaactgttcaatcgcaagggtgatatgttccgttgctttgctcgtctgctcagccgaagccgtcagctcctctgaggaagaagcgacatgttcaacagagtcctgaattccctgaataagcgaacggagtgaatctgtcatatgattaaaacttttaccgagcacgccgagctcatcttgagagccgacatcaatggtttccgtcagatccccgctgctgattttttccgctgaagctacgagacgttttaacggtttggtaattgagcggatgacaaaataaatgaaaatcatccctgcggcgatggctatcgccaatatgataatggccagagtcagaaccggtcttgccgcatctttgatttcatccacggacatggttccgctgatcttccagcccgtcgcttcattggtcacgtacgccatttttttcgctttcccgttcagcgtatattcatagtcgcctttttgcccgctgtataatgtatcaacccattttcccgataccgccgcgccggctttttcatcactgtaagcaacggcttttttatttttgctgaggataaaggcgtatccttcttttccgatgttcacttcttttgtcatcgtgatgagatcgtcgatttttatatcaatggcgacgacgcctgatccgtcttgcgccgcgcgggccatggtaacgaccatctttttgtttgagatagactcataagggtccgtgatgatggtttggcctttattctccatggcttcctgataccagcttctttcaagcggattgaaatcggccggcatatcggcatgcggataacgggtaaacgttccttccttgctgcttgaaaatatggcggacgctttatcattgctttcaataaactgtttgaacctttcttgcatttccgtttggtttttttctttaaatttagcgcttgtcgcccattcgctgaaatatgctgagctttttgtaaacattccgatccggtcatcaatcatattgtttaagatttgcacatttccttcggcgctttccatcatttgcttttcaacggatgaagcggccgaacggtaggcgccggcagccaatactgctaccggaataattaagatcagtaaaaatgaaataataagttttttggctattgattttctggcgattttttttgctgtttttttcaattttgtaaacctctttcaatcatttactgtttatatcggccgactccctttttattacattgaaaattaagtcataaatgaaaaatagttctatgtactccctttgtatgcaagactttttatttaattatccggctgtcactataaaaaaggacgccttccacctggaaagcgtccttttttactagttgattttaaattgtttcgttaattcccgcagttcttcggccatttgcgccaacgtatcggcggatgtgctgatttcttccattgatgcaagctgttcttctgcggatgcggcaatatcctgaatgcttgctgcgctttcccgtgatacgtccgcaatatccgtcactgcggctgaaacgtgctgagagctgtctgacagctgttcaaccgtgccgttcatcgattgaagcttctcggcgatatcgttcgtcatgccgaagatattctggaagctttctttcgtgcggtccgtcacggcaagtcctgattgaacttcttcattgacggatgtaaacatgtgaagcgatgtattgatctcagccgtgatttcctgaatgagtttttcaatctctttggcagaaccggcggattggacggcaagctttctcacttcttcggctactactgagaagccccgcccgtattcacccgctcttgccgcttcaatggctgcatttaacgcaagcaggtttgtctgatcggcaataccgttgatgactcttaaaatatgagtgatgtcttttgatttggcctcaaggccttttacaaccgcttccgcctgctggaccgattgattgatgagattcatctgcccgacggtttgctgcacatattcttccccggtgccggcagcttccttcgattgtttagatgcttccgtaatggatgatgatgtgcgggaaacggcggcgagtccgtcatttatatgattcagcttggctgagcttgaatcgactttttcgctttgctcttcgttcccgtttgaaaactgctcaatcgccattgtaatatgttccgtcgctttgcttgtctgcgaagctgaagcggtcagctcttccgatgacgcggccacgttgtcgacagagttttggatcgcgcttatcagtccgcgcagagattctcccatttcattaaagctcgcgccgagttcgcccaattcatctttcgagcggatatcaatggtttcagtcaagtctccgccgctgatttgtttagaagagcggacaagccgtttcagcggtgacgtaatggatctgacaatcaacagaattaaaattcccccgatgataatggatgctgcaaggacaatcatccccatcgtcagcaccggttgtgaggcgtctttaatttcgttgagctccatgctcccctctattttccacccggtcagtttatttgtcgtaaacgccatttttttattttgatcatcgagcttgtatgaaataatgccgctgtctttgctgtatacctcattcagccacggggttgaaactttatcgcccggtttgtggtctttatgcgcgacataggttttatttttggacgtgataaacacgaatcctttttgtccgattttgattccctgcatctgcttcagcagctggtcaatcgtaatatccatggccactacgcctgttccgtcctgcatctgctttgccacggtaacgaccatgctgccgtcgcttgccgcggtgtaagggtcggtgacaacgagcgtgccgccggccttcacagcgtctttataccaggtgcgtgttctcggatcgtaatcggccggagtattctccttcggcgcctgtgcgtagctgccgtcttccgtacctccgtaaatgcgggctacgtccttatgaatagacgtgtattgcccgaacttttcttcaagagcagacatgtttttctttgagaaggatgacccttttaacgtttcactgaaaaattcaatcgcctttgcttttgcgccgatatcatttgtaatggttgtgttaaaagattcgatgttatttttcgcgttgcctgaaatctgatcatccagcgaattgctcgccgtatggtatgaactgaattctaacacgagaatcggtatgattaagatcacgataaatgaaatgattaatttacgtgaaatcgatgcctttgtgcaccaattaatgaattttttcatattaagctgctccctcaagtgtgataccttatatatcggctcagtcttcacattttgttaacatttcctccttttttatgacttgattttcattgcccaagcttcctgcatatcttataaaaaaagatagggggcgcgcagatgattatcatatccggccaagtgcttcggcctcaggacatcgcgaactggcagacggaagaaagccttgttccgtatataaatgacctgctcaattctcccgtacaattcgattacgggtcgattgctgaactgatgttcgaggtgcggctgcgccgccatattgtggaagccgcaagagaactgcacggatcaggtgtgaaatttgcaactttcgccaaaacatacggaaatacggcttattggagactgacgccggaaggagccctggagctgaagtacaggattcccgcttcaaaagcgattcgggacattattgaaaacggggcgttttacgcatttgaatgcgctaccgccattgttgtgatttattatctggccgtcttaaagacaatcggtgaagaacggtttaacctgcgtttccggaatatcactttgtatgactggcactatgagcacctgccgatctacacggaaaccggcagccactttttacggggagattgtttatattttaaaaatcctgattttaaccctgcaaaggctcagtggcggggagaaaatgtcattgtgatggggaatgatcaatatttcgcccacggtctcgggattctgaccgctgaacaaatcatccagagattgaattctttaagaaaaaaaaatgccgtgcagccggcttatctgcttaaccaggcaacaaggcttgatgcacccgcgctttatcagatcatgcattaaaacaatcccatcgtctgtcattgtgacgatgggatgtgaaatgcttttcttttccggtaaaaagccgtcgtgccgagcgcttgatttgcagcccattcaaacttctctaaatcatggcgggtgacggctctgtcccgtctgctccatttaatggcgcggacaaaataataccctttaatcggcgccatggtgactttggaatgtggaaaatcttcaaagacaaactcaataatccctctttttttataggacatttgaagaatcttcatcatccatcacctcacgatttctggattatgattcgcacaatccgtccaaaacggttttcacgtctgtcggcccttcaagtttcgcggcggactggccggcccataaagacatatactccgcgtctcctgattgagccgcgtgcccgcgcatcggctttgtcagcgtattatgcagcggataaggcagcgtttttccctcatcagcttcatatgttttcatgaactgattcacgattccccgcgcctgttttcccgaaaacagggtggtcagccgcgtatcggctccttttgattcggcaatggctttttggtatgccggtgaggcgctgctttcttcacaaaggagaaacggtgttcctacttgaacgccgtccgcacccaaacatcgggccgcctgcaccccgcggcggtcaaaaatgccgcctgccgcaatcaccgggatatccagcgcgtctttagcctgcggaatcagcgccataaggccgagagccggttctcctttaaccggcagaaacgacccgcgatgcccgccggcttctattccctgaaggataacggcgtccattccccgttcttcaaaagccttcgcttcctccggcgttgtcgccgtgccgaaaaggaaacaaccgcttttcttcagcttttccgccgtttcttccggcggcaggccgaaggtgaatgaacacgctttgattccgtaacggatcagaagctccgctttttcctcgaaatcattccattcttctttcagatcagagaacggcttggcgtcttttgccctcgggatgcgggctttccatttttcaacgagttccgcctcaggcatctgtctttcttccgggacgaaaagatttacttgaaaggagcggtccgtcagctctttcatctcgataagctgtttttcaagcgcttgcgggctgacgtatcctgaagcgaggcttccgagcgccccttcatttgataccgccgaagccagacgcggcgtgaccagtccgccggccatcggcgcctgaatgacgggctttgttaatgataatggacccatccactcactcatttgttttcctccgtttcagcctgtattttgatataacatgttctgtttcgcggaccgtcaaattcgcaaaaataaacgccctgccatgttccgagtatcaggcgcccgtcttctatgatgacatgctgagaggcgccggttgtactcgctttcatatgtgccgccgtatttccctccatatgccggtccagttcgtgctcccacggatacacttcgtcaaacctgcggagcatatcccttttcacatccgggtcggcattttcattgatggtaatgccggcggtggtatggggacagtatatgagcgccaaaccgttttttacgcctgtttcgcggagaaaagattcggcttcatgtgtgatgtcgatcatttcatcccttttttttgtttgaatctgcaattttttcagcatatgaatgcctcctttctttttctcttcctttcccatattcgtttctgtatttgtcttttcctgtcggatcgcgatgataaacgcagatcacaaaaaacttcagcctcgggactgaagtttttcaccatatatatacgcgggcctcataaggctttaagaggaaggatgtcacatggcggtgcgcttctgtttccgcgtttgcaagcacgagagaagcggagtcaagcggataaccgggatgcctgtataaagcgggggttcgggacagatttgtgatgatcagggcggtttttgttccgttttttcttagataggcataaatctgccggtcattcggaagcagcaattcatatgtgccgctgatcaatacgccgtgttcttttctgagggcgatcagccgtttgtagaaatggtatacggatgtttcatcctgcaattgtgatgcggcgttcagccatgtgtggttcggattcactccgagccacggagaagcatcagaaaacccgccgttcgcctcatcgctccattgcatcggtgtccgtgaattatcccggcccttcttccaaatgatcttcatcacttgttcacgcggaacgccgcgggacgtctctttttcatacatatatttaattgcggcgtcatcataatcttcaatggatgggaacgaaacattggtcattccgagctcctgcccctgataaataaacggcgtgcctttcatcagtatatacatcgcggcgagtgccttggcgctttctgtcaaaaaccgttcgtcaccccataccgaaacggaacggggctggtcgtgattttccataaataacgcattccagccctttccttcaaggctgttctgccagtcggacaagacgcgcttaagcgccggaatggagatgctttgatcatcttccgtatcccagaggccgagatgttcaaattgaaaaatcatttgaaagacgccgttttcttcaccggcccaatcagccgcctcccaagccgccactccgttcgcctcgccgaccgtcatgatcggatagcgagaaaatgtttcccgcttcagctcttttaagagatccattatgccttccccgttcatatgatacgggaaagacgggacgtacgggagaccgtccgggttcggcatgtcagggagcccttcttttttcttaatgtgagaaatggcatccacccggaagccgtctatgcctttatcaagccaccagcggaccatctcataaacggactgcctcatcgcttcgttttcccaatttaaatcaggctgttttttgtcaaacaggtgcaggtaatactggccggtctcttgatcatattcccacgctgatccgccgaaaatgctttcccaattgttcggctctttgccgttttttccgtctctccagatgtaccagtcccgtttttcggaatctttcgctgagcgtgattcgataaaccaagggtgctcgtcgcttgtatggttgatgacgaggtctataatcagcttcatgccgagcgcatggacatccgcaaggagcctgtcaaaatcctccatcgtcccgaattcgccggcaatttgtttataattccgaatatcgtagccgttgtccgcgcccggcgagtcaaaaacgggacaaagccagatcacatccgcccccaactcttttatgtaatgaagctttgctctgatgccgttcatgtcgccgattccgtccccgttcgaatccataaagcttcggggataaatttgatagacggccgccgttttccaccaatccgttttcataccgacactcctttctttacagcatatgaaggagcgggacgaagaagcattttttccataaaaaaagcctcattgcaaaagcaggaggctcagaaatcagtttttttaatctcaacgaagcggatatgatggtcttccgcttccagcaccttaaattcacacccttcggcatgaaacacatcaccatttttcagctccattttttgtgttaagagccagccggcaatcgtgtcaatgtcttcattttcgatggcgatatcaaggagatcattcacctcttctatgagcgccttgccgtccatcacataatggtgttcgccttttttgacgatgtggggcatttcatcctggtcatattcatcacggatttccccgacgatttcctccaatatgtcttcgacggtcacaagtcccgccgtgccgccgtattcgtcaacgagaatcgccatatgaatccgctccttctgcatgcggatcaaaagctcctgaacggggatgctttcaatgactctgatgaccggacgcataatttcttttaattcaatggagcggccgagaaaatacgctttaaataaatccttattgttaataatgccgagaatgtgatctttgtcttccttaataaccggatatcgcgtataccgttcgttgatgatcaaatgtatggcttcatcaactgactgttcaagcgagatggcggcgatttcggtgcgcggcaccatgatttctctggcgacccgattatcgaattcaaatattttattgacgtaacggaattcagattgattgatttgaccttttttatagctttcggacaaaatcagccgcaattcttcttcactgaccacgacctcatgttctttcaccgaatgaaaaccgaacagcttgaccaaaaatccggctgagccgtttaacagcttaataaacggatacatcactttataaaacagaatgagcggtttcgccgtccacagactgacggcttcggctttttgaatggatatcgttttcggcgcaagctctccgatgacgacgtgcagatacgtgacggcgataaacgccgcaataaacgtgacgacgtgcgtaatagatgacggcattccgatcaggctgaaaacaggatgaagaagccgctgaatcgtcggttcaccgagccagccgagtccgagcgccgtaatcgtaatgccgagctggcacgctgataaatattcatcgagatttgaaatcaccctgtgcgccgcgagcgcccggctgtctccggtttcaaccagctccgcgatttttgaaccgcggattttgacaatcgcaaattccgcagcgacaaagatggccgttaatccgattaacagcataatgagaatcagttttaatataagcaaaaaaacccctaccgcaaacggtaaggggccacctccttcgtgttaattctcatcacgaccatttaagaaaatcatcacaaaacgaagcagctcgaataatgaaacgagcgccgcagccacatacgtcagcgcggcggcgttcagcactttattcacgccgtgttcttcactgttgcgaatgaatccttccgacacgataatccgcttcgccctcgcgctggcattaaactcgacaggcagtgtgacaagctggaaaaaaacagcggccgaaaacaaaataatgccgagtccgattaagttcaagctgcccaggagcatcccgcccaagaaaagcagaggggcaaccccggaggcaaaattgacgaccggaaaaattttgtgcctcagcacaagcgcgccgtatgattcctgatgctgcaaagcatgtccgacttcatgagaagcgacggaaatggcggaaatggagcggccgtaatataccggctcagataaacgcaccacccgctccgtcgggtcgtaatggtctgttaaagtgcctcttaccggttctaccggcacatcatataaaccgttaatatcaagaatccgtcttgccgtttccgcccccgtccgctgactggaggcttccacgtctgagtatttctgaaaattgcttttcactttaaattgtgcccaaaacgacaatcccaatgcagcaattgttaaaaagataaacagcatattatcctcttcctttttctcttatatcgtacgatctgcttatatattattttaatgattgcccgctttcctgtacagaaatccgcttcttttttctgacaggaatcaatcctccgagcatgatgaggatacacccggccattccgatgtaaaacggaaacgtgcctgcggtctcttttgcaaaaacaagccatgaaaatccgccggacatgtgattgtatccattcaaatcgaaaataagcaatacggccgccgaagcgagcagctgcgctccggccagcgccgccagcagtttttgaatgaccgtcatttgactcaccctttttcggtccgctttctttatcatatgaaaaaataagggtgaatatgttttcggcgatttttgaaagacatcaaacgaactgggacatactgtattaaaaaagatacaggtgtgatcgacatgaaagtgacaaatggcgagaaagaacagctgagcaatgcgatagacagaatgaacgaagggcttgacgccttcatccagctctataatgaatcggaaaacgacgaacctctcattcagtttgaagatgagacggccgatttaatcagacatgcgcgtgactcatacggccaggaacagctggacgaaaaactaaacaccattattaagcagattttatccatctctctgtcgaaagaagagccggacgaatgaaatcaaaccgtatatttatttcctggctgagatggccgttatatgttcggatcgggctgatcattatcgccttgattttattgttcggccaactcatatacatgctcgaaccgaagcagttcacgtctgtgtttgaaggggtttggtgggcggtgattacggtggccacagtcggctacggcgattacgttccgcagacgccgctcgggcagattgccggcatggtgcttgtattaagcggagcgagttttgtgaccgcctatttcgccacgctttcttcagccgtattcagcaaacagcaccgctatgtcgaagggaaggtcgcctttaaaggcaaggggcacgtcattcttatcggatggaatgaaaaatcgcatatgctgctgaaagaactgcagcacatcgcaccgtcaaaaactgtcgtcctgattgatgattcattaagggaagggccgcttattgaaaacgtccatttcatccgcggacatgccgctgatgacagcacgctcaataaggcgaatattacggaagctgataccgtcattctgacagcggaccagcagaaaaatgaatccgaagctgatatgctgtcggtattaacacttctcgccatcaaagggctgcatccgtccgtttattgtatcgtagaaattttaacggaacggtatgtcaaaaacgccgagcgcgcaggagccaataagattctgtgcacatcacgcctgtcgagccgggtgatgtttgagcattaccgggtcaagctgcagcttgccaaaccgcaaacgctgtcagatctgacgctggagaaaaaggtgcgcatcattcccgtccccgaggaactgaagggctcatcttatcatgactgtgcgctctattatctcaaacggaataccacgatcatcggcatacaaaaagaagaggggccgatgctgacccctcccctgtcataccaggtgctcgatactgatctgtttttggctctttaatgcagcaggacgtcttccagctctttcacaagcgagatgccgatatctgtatatgagcggtcaattgccgcatcccgccgtttcggctcggagaattggttgaataatgactcaaaaacaccgccgcctgctgcatcatccgtttcctgttgataaacgtgcctcagcaaaaagggtgtgccgattgtaacggcggccccccgttcatccatgtgtcccttatttgcttcaacagggatacggagaaataaatagccgtcctgatcggaaattttgtaatcaaagaacccgcggtcatactcccagccgcctccgatggtataaccgatcggtttcatcacctgttccaattcgcggagtaaaaacgattgcccttcaagtgaagatggtatgctgatcatgtgcatatgctcctttttgtctttagcgtccccgctctgcggtatcttcatacggcgtccgggaagaaccgggagcggcagacagacgctgaaaagaggtgacggcgcattcaatcagaacatacgtcacaattgcggagagaacggcttccgttgaaatatagaaaacggcggcatagagacagcacttcgtgatcagcgtatgcatccggccaattttcagtttcagccggaccatgtccgtaaacaagccgagagggaaagcgaaaaacaggatggtttgcaagagggattcaggagacagttttagtgccgaatagacgacagcggcggaacagacggaaatgaagacatgcttacataaaagccgcatcaattcatcatcacacctttcacggtttaaaaaaggctgacccatcatgctgagggccagcccttctttttatttttcaaggcgtttttcaagctctgcttttttctcttcaaagcccggtttgccgagaagcgcgaacatattcaccttataggcttcaacacccggctgatcaaacgggttgactccgagcagataaccgctcatcgccaccgctttttcaaagaaatagacgagatatccaaatgtatatgcgttaagctccggaatattgacaattaagttaggcacttttccgtctgtatgggcaagcatcgtgccttcaaacgcttttttgttgacgaaatcgatcgttttgccggctaagtaatttaagccgtcgagatcattttccgcttcttcaattgtcagctcatgcttcggtttttcaacgttcaacacggtttcaaacagatcgcgtctgccttcctgcacgtattgaccgagagagtgaaggtcagttgagaagttagcggaagaaggatagatgcctttttcatcttttccttcactttcgccgaagagctgcttccaccattccgcaaagtattgcagcgcaggctcatagttgatgagcatttcaatggttcttcctttattatacagaacgttgcggacgacggcgtattggtaagccgcgttctcttctaattccgagctggaaaagtctttgcttgcatcaagagcgcctttcatcatttcatcgatatcagccccgcttaccgcaatcggcagaaggcctaccgcagtcagaacggagaaacgtccgccgacatcatcaggaataacgaatgattcgaagccttcttcattagaaagcgtttttaaagcgccgcgctctttatctgttgtcgcgtaaatccgcgctttcgcttcttcttttccgtatttttcttcaagaagtttgcggaaaatccggaaagcgattgcaggttccgtcgtcgtgcctgacttagaaatgacattgatagagaaatcagcgtcttccaaaagatccataacatctttcatataagttgagctgatattattgccgataaagataacttgagggtttttgcgcttatctttcggcaaaacattatagaaagaatgattgagcgcttcaatcgccgcgcgggcgcctaagtatgaaccgccgatacccacgacgagaagcacgtcagaatctgatttgattttttcagcgctttttttaatgcgcgcgaattcttctttatcatagttttcagggaggtccacccagcctaaaaagtcgcttccggcgcctgttttttcatggatattatggtgtgccgtttttacgaaatcacgtgcgtatgtaagttcatgttcattgaaaaaaggtaacgctcttgagtaatcaaagcgtacatgcgtcatttgcttgtccctccatcacggtgaattgttttctctttcactttatatgaactcacccgctaaatcaagtcatgaagaaggcatgatgaatacgggatttgcgctaaagatgcgttcattttttatacaatatcccggattcgaaatagttatatttgtaataatcgtgaaagaagtaacgaatcgaatgttggtgatccaggaacgtatcacctttactttggagcaggttgacatccatcgccaataccgatgggacggttctttttatatagtactcctcttgagaggatgccgtgcaggtatattaaggaataaatgtccatttttaaaaatagtgtctatatttggggtatcatgttaagatgaaaataattttaaaccgggaggtgattttatgactaaaaccattggtcttatttgtggaagtttacgaaaaaactcgtataatcgagtgattgctcaatcattgattgacttcgataatgcggctcaatttcgctgggttgaaatagacagtcttcctttttttaacgaagatttagaaatcgccggagcaccagactccgtaacatcctttagagctgatatacgagacgttgacggcgtcatcattgtaagtccagagtacaattcaggaattccgggggtattaaaaaatgcattggactgggcatcgagaccgcggacctcttctgttttaaacagaaaaccggttggcttaatcggagcaacccccggagggttcggcacctcttttggtcaaatgcaaatgagagaagtactcgaagctatgcaagtcaatgttctgccctttcaaaaaatgctgatttcgcaagtccatgagaaaattgattccgctcaaaacatacttacggatgaacaaacaaaacgttatcttcaacgctatttacaacagttcatccattggattgatcatgctccggttcccgttccggattaattgaaggatcatcaccctcacgaaaagtcacctcagaaataactttctatctatacagcatatgaatagatttaccgttttccattgacaaactgacttgccttaattcaaggaggatgataaaatgtctgatctttattcccgtctttcaaaagatgatgctgccgtgcttttagttgaccatcaaaccggccttatttccggtctcgtgcgtgactatggcgttgatgaatttaaaaacaatgtattggctctcggtgatacggctaaattctttgatttaccggttattttaacaaccagctttgaaaatggacccaacggaccgctcatgcaagaactcgctgatctctttcctgatgcgccaaaaatagcccgtcccggacaaattaacgcatgggacaatgaagactttgttaaagccattgaagcgaccggcaaaaaacagctgattatcgcgggggtggtaacagacgtctgcgttgcttttcctgcgctttctgccattaaagcaggctacgaagtgtttgttgtgacagatgcttcggggacgtttaataagcaagtagcagatgcttcattaacccgtatggctcatggcggcgcgcagcttatgaactggttcagcgcagcatgcgagttacagcgtgattggcgcaacgacgttgaaggttttggcgcattaatctccagtcatcttcccggttatcaaaacttaatgggaagctatatgggggcgcagcgggaccttagtacacaaaatgcataaaaaggagcgctgattgaatcagcgccccttttttaaattcgcggctcttcatcttcgtgatttagatttcgtgtaaatagatgacaggcaatcgcaaagttaattggtccttttctgctaaatgtacagaaacagggagtcaaatccgcatcatgtgatacggatgaaacgatttccatagttgtctcatggcaaagggtgtttcacttgctcctaatgaactaatagaaaatccggaaagagggactcccaaaacggttacatctgcagcttgaaaaccactccggcctggaatatgatcttacagtgacgcctttaagatggcaagtacgtcatctttgttcagtttttggaaattgccgaatccgccgtattccatttcttttgcggcgatgtctgcgatcagctcaagcttgtcttcgccgatgtcataatccgcaagacgggacggcgcgccgaggcttgaccagaacgcggacaatttatcgattccttcaagcgcaatttctttatccgttttgccttcagtatcaatgtcaaacatattaagcatgaggtttttaaaacggtctacatttgtatcaagcgtgtatctcatccagttcgggaacagaatcgcaagtcctcccgcgtgagggatgtcataaaccgctgatacggcgtgctccatcgtatgggaagcccaatcgccgaaatagcccatttgcagcgtgccgtttaatgcgatcgtacccgcgtataaaatcgtttcgcggtgcttatagttctcaaggtcttccaaaagtttcggcgctgtttcaattaccgtctgaaggaccgcaaaacacattctgtcctgaagcggcgtgttttcaacattgtggaagtattgttcaaatacgtggctcatcatatccaccatgccgtatacggtttggttttccggaacgctgaaagtattctcaggatctaaaatggagaaacgcggatgagtgacattgctgccccatacgaatttttcgtttgtttcccaatttgtgataacggaatcagggttcatttcagagcctgtcgccgcaagcgtcagcaccgtgccgaacgggagcgcgtcctgcgccgttacttttttgctgtaaatgtcccatgcgtcgccgtcatatttcgcaccggccgcaatcgcttttgtacagtcgatgacacttccgccgccgactgcgagaaggaaatcaatctcatgctgtctgcacagctcaattcctttatttaccgtttccagacgcggattcggttcaacgcccgcaaactcatgaacggttgcgccttcttcttttaagatgcctgttacttggtcatacaggccgtttcgcttaatgctgccgcctccgtaaacaagcagcacgtttttcccgtattgcttcagctcttttttcaattggtcgatttgaccttttccaaaaatcagtttcgtcggattgtagtacgtaaagttctccatttatcatgacctccaaaaaaatcgtaagggaattactataacacagaaaaaaaggagctgccaatccggccgcccctttatgttattacaatgatgctttcagtatcgcaagcacatcttctttctgcagtgacttgaactgtccgaatgctccgtttgccatcgctttatctgcaatcgtatccagcttctcatcagaaatatcataatcagcgagtctgttcggagcgccgagactcgtccagaaatcagacagcctgctgattccttcaagtgcgatctcttcatctgatttgcctgtctcgtcaatatcgaaaacacggacggcaagctgtttaaagcgggccggattttctttgagcacatgtctcatccagttcgggaacagaatcgctaaacccccggcgtgcggtatatcgtaaaccgctgataccgcatgctcgatgttgtgtgtggcccaatcccctcttgcgcccattgacagcattccgtttaatgcgatcgtgcctgtatataaaatcgtctcacgaagctcgtagttctccagatcattgatcagcttcggcgctgtttcaatcaccgtgcgcagaagcgattcacacatccggtcctgatacggcgtgtttgacgtgtggtggaaatattgttcaaacacatggctcatcatatcgaccatgccgtaaatggtgtggtctttcggaacggtaaaggtgtttaccggatcgagaatagagaatttagggtaaacgagcgggctcccccatccatatttctcttgtgtctcccagtttgtgatgactgatccggagttcatctctgaaccggtcgccgcaagtgtcagcactgttccgaacggcagcgcttctttcggctggtgttttttcgtgacgatatcccacgcgtcgccgtcatatttagcgcccgccgcgatggctttcgtgcagtcaatgacacttccgccgccgacggccaataagaaatcgatgctgttttctttacagagcgcaacacctttgttcactgttgagacacgcggattcggctctacgcctgccaattcatgtacagtaactccggcttttttcagcagttcggttacttgatcataaagaccgctgcgcttaatgctgccgcctccgtatacgagcagtacgttctttccgtacggcttgatttcttcaggaagtttttcgacctctccctttccgaaaatcaatttggtcggattccaatatgtaaagttttgcatgacatctcctcctttggatttatattatgcagaaagttgacgttcaatgtaaagcaatccgcttttttgacggcacacatcacacggtttacagacagcggcttcccgggaaaggcacttgtacagcttgagacagtgtgtgatttacacggcagagaaagtatgcatagattctttgctttgtcacaatctataactgtttcacgaattcatagaggaggttgtttacatgagtgttattcagcgtatctgtctcgtattaacgattatcggcgctattaactggggactgatcggatttttccaatttgatttagtagcagccatcttcggcggccaaggatcagctctgtcgcggattatttacggtcttgtcggcatcgccggtctgatcaatctgggcctgctgtttaagccgaacgaagaaacatcccgcgaggaagcggcaaatcctgaagtcagataaacataaaaaaagcaccgaacatacatatccggtgctttttttgatggttattttttgataaggtctttgcggttggactgttcgatccactcttcaagcttatctttcaatgtgttgaaaccttgcggagcagatgtttcttcagaaacttgtgccgctttcggttttcttggtttgctttcttttctttcaggcgccgcttgagtcgcacggatagaaaggctgattttgcctttttcttcgtcaactgcaagtacttttacttgtacttcgtcaccgattgaaaggtgttcgttaatgtcttttacgaaaccgtgagtgacttcagaaatgtgaacaagtccttgagtttcttcatctaatgcaacaaacgcaccatacgcttgtaatcctgttactttaccagtgtaaacactgcccacttcaaattttgctgccattcataacaactcctaagttaaattaaatacagattatacgcaatttaaaattatatcatacaagtttgtttttcgcaaagagaacttttttacatgatcatgtttaagcacagataaagggggtatactatgattacgaaggctttctagtattcccccttttatttggatgcgaaccgggttcgtatctttttttatgcccttttttcaacaaaccgtttgattctgacgagcgcttcctgaatctgctcaatggatgtcgcataggaacatctgatgtagccttcgccgctcgggccgaatacattccccggaacgacggctactttttcttcaatgagcagctgttccgcgaattcttctgaactcatgccggtcgattgaatggaaggaaaggcgtaaaacgctccgcctgggtggtggcagccgagtccgatttcgttcaatgtttccacaatcaggtttcggcgtctccgatagctttttttcattctttcgacgtcttcctgaccgtttttcagcccttcaagcgccgcgtactgagccatggaaggcgcgcacatcatcgcgtgctgatgaattttgagcatggcatccctgatcacgggaggcgccgccgtaaatccgagtctccaccccgtcatggcaaatgctttggagaaacctgaaatcaaaatcgtccgctccttcatgccgcggatggcccccatgctcgtgaatggctcatcatacgtcagttcggcataaatttcatcggcaagcacgatcaagtcgtgtttttcagcgaaagcagcgatggattcaagctcttctttcgaatagacggaaccagtcggatttgacggcgagcatagaagcagcgcttttgttttgtccgtcagggccgcttcaaaatcggctgatgatgctttgaaaccttttgcagctacagtctgaatcggcaccggcttcgcccccgtcagggtcacgagtgattcatatgcgacaaaacacggttcgggaattaacatttcctctccgggattcataatggcgcggacagcaagatcaagcgcctggcttgcccctaccgtaacgatcagttcactgtcaggcgaataactcaggccgaaccgctgatctaaatagcggctgatttcttctctcagttcataaagacccgcatttgccgtataagccgtataaccctgttctaaagaaagaatactcgcttccctcacgttccaggccgtcacaaagtcaggctctcccactcccagtgaaatgacgccttccatcgtagcagccagatcaaagaatttgcggatgcctgacggtttaatctgctgcacgtagtcagataaataagaagtcttcgtttccatttacggagacaccacgattcttttgtcatcgtctccgctttcaaagactttgccgtcatgcttatattttttcaggataaagtgcgttgtcgtggaaacgacggactcaagggtggacagtttttcagaaacgaagcttgccacgtctgacatcgtattgccgcgaataacgacagataagtcataaacccctgacatcaggtacactgattcaacttcctggaatctgtatatccgttcagcgacttcatcaaagccgacatttcgtttcggagtgacttttacgtcaatcatcgccgtgacgccttccagcccgtcgactttgcgccagtcgatcatcgccgcataatcaatgatgactttttccttttcaagcttttcaatgatgcttttgacttcttcggcgggaatgttcgccattttcgcgatcgtttccgcatcaacgcggctgttttcgtctaaaatttctaatatttctgtttctttttcggtcagcttcatacgtttcacacctttgcattatcaaaaatcttcatgacattatatcacgattttcgacaaatgctaagaaaaacccgaaagaaaccagagctaaaatctgacaatcaaaaaagcctttacattacaacaaagaaaggacggcgaaggctctcatggaagctgtttcaccgattaaacgggccgcgatagacggagttgagctgtattacgagcattatgaaaatcccggcagacagacactcgtctgcgtacacggttttttatcttcggcattcagcttcagaaaactgatcccgctgctcagaaaccattatgatattatcgccgttgacctgcctcctttcgggcaatcggaaaagtcacggactttcgtatatacttacgcaaacctcgccaagcttctgatcggacttctggaaaagctcggtatcagccgggccgcactcatcggccattcgatgggcggccagatttccttatccgcgtctcttctcagacccgagcttttttcaaaaatcgtcctgctgtgcagctcggggtatttaaagcgctcgcacccgtcgattatattcgggacgcacctcccttgttttgacctgtatcttaagtattggctttcaaaagacggtgtgctgaaaaacctgttaaatgtcgttcacgaccggacgcttatcgatcaggaaatgattgacggttacgaaaaaccatttacagaccgccagattttcaaagcgatgacaaggttcatcagacacagggagggcgatttagagcccgaggatttgaagaaagtgcaaaaccccgctcttttaatatggggagaagaagaccgtgtcgttccggtctcagtcggaaaacggcttcatgacgacctgccggattccattctgtattcactcaaggatacgggacacctcgtacccgaagagcgcccggagtttgtttcagagcggatttttgaatttattcaataaaaaaaccggcggaaccgccggtttttaaggggtgcaggaactgctttcttttatgaacagaagctgctcggcggccttttggcagccttcgatcggaagcttttgctcaaatgaagcctcaaagatatcctgaatggctgctgccagcttgtcggcacggtcttcactgtagacggcctgaacgatgtcgacggcttctgtctcataaaaatcttctccatatttaaacgggtcccacttggcaatgattttcatcatttccatgaccgcttggctttcttccattttcatcaccgcttataataaagtttgcaaatctattttatcatagatacgctgtgcaaaataatgatactacaggagtgacatacatgaactttgatcttcgagaaaaccgtcttggcacacaatcggtgaaatgggacaaggcggaagcgttattcggcgtatcggatgcacttccgatgtgggttgccgatatggatttccgcgctcccgaagcggtcactgacgccttaaaagcccgccttgaccacggcatattcggttatacgtctcctgacgaaaacacaagagaagccgtcgcttcatggcttgagacacggcacggctaccggcccgatcccgcaagcatcacgttcagtcccggagttgtcacggcaatcagcatggcagtacaagcctttaccgaaccgggcgatccggtgttgattcaatcaccggtgtatacgcctttttatcagatgatcaaggaaaacaaacggcaggttttacataacccattacgggaagaaaacggcgtctactgcatggattttgaggatcttgagaaaaagctgaacgattctgaggtcaagctgatgattctttgtaatccccacaatccgtccggcagagcgtggagccgggatgagcttatgaagctcggatcgctgtgcgccgctcataacgtcaccgtcgtttctgacgagatacattccgacttgatgctgtacggaaagccgcatacgccttttgcttctctgtctgaggagtttgcgcggatttccgttacttgtgtcgcgccgagcaagacgtttaatattgccggcattcaggcatccgccattatcattcccgaccgttataagcgggcgaaattctccgccgcattgcatcagaacgggatttccagcctcaacacatttgcggttgcagcaatcgaagcggcttatacaaagggaggcccttggcttgacgcgctgattccatacattgaagggaatatgaaattggctgaggactttttaagaaaagaattgccgaaagtccgcatgatgaaacctgacgcttcctatttgatctggatggatttcagcggatacggattttcggatgccgagctcaaagaaagaatgctcaaaaaagggaaaatcatattagagccgggaacgaaatacggaccgggcggcgaaggatttatgagacttaatgtcggctgttcagccgtcgccgtaaaagaagggcttgagagaatgaaagcagcgctcgcttagcagcggaaagaacgcctttatcagacgagataagggcgttcgctttagagaaatatatactttttttgccggtaaagatgttataatagattcatatttacataggaaaggatttcgcataaatggagattgtaaaggattacctgcttcacttctcttttattttattccctatttttctttatcaagtcttctggctcagcaagcccgatttgcttgtgccgagagcgaaccgcctgctggtcgccgtatttgcagcgtcatcttcattattatgtacggcttttcccatccaggagcttcattccgtccgttacggtttgcagctgattcccattatcgtctgcctgctttattccggtaccgcagcaggacttgccgcaggggcggcatccgttttttttcagctcatatggtttgaaccttccgctctttttttcttatccttaattccttttttaatcatcatccctatccagctccaaacgaaatggccttttttctcaaagcggaagaaactgcttttcgctcttctcatcggctgcactgaaaccgccttattaaccgcatctgtcttcatctattccgcgaccaatattttcaattttcaaaatctatcttccgtttattatgaggcggcagtatccgttttttttcaagtcagcgcccttttgctgtgcatttatttgattgagatcatcgatgagaatgcgtccatgcgggcaaggctgattcactcagaaaaaatggccgtcgtcagcgagcttgcggcaagcgtcgcccatgaagtccgcaatccgcttacggtcgtcagaggttttgtgcagctgctgttcagcggcgagcagcttcaggacaaatcccactccggatatcagaaacttgtgctgtccgaactcgaccgggctcagacgatcattacgaattatcttgatatggcgaagcaggatgactatgaaaaagaaaagtttgatatttctctgctcgtaaaggaaacaggttccttaatggagtcttatgccaattttaaatcggtgaccgtgactgttcaaagcgagcctgatttatatgtgttcggcgatgtaaaaaaactgaaacaggccttcattaatctgattaaaaacagtattgaagccgtgccctctgaaaacggccgaatcgaggtctccgtccaaaaacaggaagagatgattctcattcagattacggataacggaatcggcatgtccgatgaagaactgcagaaactcggcaaaccgtattatacgctgaaaacgaacggcaccgggctcgggcttaccgtgacattctcgattattcagcatcatgaaggctccgtctatttcaccagcggcgagtactcgggcacaacggcttcagtcaggcttccggcagctgttcactagccaatcgcgttgatcttttatagaataactagagagaggtgaacgctatgaattcgtttgaaatcggcacaatcgtaaaagggttttataaaacaggagcatacataggggaagtgacagacgtcaggcccaatcactatttagtgaaaattaaagccgttctgacgcatcccgctcaaggagatcttcatcatccgaagcaggcggatgttccgttctttcatgaaagaagagcgcttgcattcggggaacagacaaacataccgcatcagatggtcaaaccgtttgatggcgaagttcctgattatacggcttccttacaagcggcgtctgcccggctgaaagatcagcttacagcggacggctcagaatgggcggaacgttcgctcgccaacttggccgcgttagagcgtgactattttaaaagaacttgacccagtcggcatgattgggtttttttatgtggcccggcgaaacagttcagtcagatcgacgcgatcaccgatcgtcggaggtttcggtttttcaagatattgtttatcccgctcgacaagcttgaataatttgtatgtcgtccgcgcatcatccagcgctttgtgatgcgtgcccgttcctttatcgccatactcttccgccgctttccaaaggccggtcaatgttctgtcgccgaagaagtttttgtattcaagggacagatcccgaagttctcctttgaacggaaaagggatgtggttaaacatgcaattttgcttcaacaccttcatatccatatttccccaggtgacgatcgtgcagtttttatcaggatcaagctcatttaatttgcggatgaattcattaaacgtgattccgccgtccacgtctttttgggtgatgttcagaaaggttttgcatcgtttcgtcagctttggaaattttttcggtttgatataactcgaaaacgtttcagtcacttcatcattcaccgtcttgacaatccccgcttcaataatctcaggaaagaaattttgcgggctgtattttccgtcaggcatcgtaaattcaaaatcaataatgagcagactgcgctgatccacttttttacacctgcctttcctccgatcaaaaatgatattttatgatagtatatcagtttcccctctgaaactttcttcattttctaaaaataatgaattttcctatatccgcatcgaaaatacaaataccggattcattcctatatactaatgattagacacacgaaaattaaagaaggtgatgttatttctgtccgtaagaagaacttcgtcgtcatttggattacaaatttctttatttccgccagcatgaccatgattgttccgtttctttcgttatatatcgaaacgatcagcccccattcgggcgggtatgtgcagagatggagcgggtatgtgttcggcgtcacgtttttaatggcgtttgtgatttccccgttttggggcagatttggcgataagcgcggctacaaaaaaattctcttgatcacaggcaccggcattgccgtcagcattttattgatggggtttgtgacatcggtttatcagctgtttgtcctgcggctgcttatgggccttgtaacaggctttgttccgacatcgcttgccatgatttcggcgcagacgccgaaagagactgccgggaaaacgctcggcacactgcagatgggtcaggtgtcaggcactttattcggaccgatgctgggcgggctgctcgctgacagcttcgggtttacgtacacattttttattacgtcttttgttattttcgtatccgtgcttctcgttttatttcaggtgaatgagcagccgctcggcgagaaacaaaacaagcggaaaacctattccagaaaacaggtgctctcctatatttttcaccagcccgcgctttgggcgatgatggtgcttaccatgatcgtgcagaccggcaatttcagcatccagccgctgctcgctttatatgtcaatgagctgcacggacctgttaatttagcctttttctccggaatggcgttttcagcgaccggactcggaagcttattgcttgcccggaaatggggggacttcggcgaccgcttcggccacagccggatcttaatcgtgcttttgattgcatcagcggtgttttttattccgcaggcgctcgcctcctccctctccattctgttagtcttcagatttctgttcggcatggtcatgggcggcacgctcccctgcattacggccgcgatccgcgtcagggcgccgggcagcatccagggagaggtgctcggctataacgtcagctttcgttttctcggaaacgtgctcggccctctgctcggaggtgcggtctcaagcggtttttctatttcggctgctttctacgtcaccgcctttctctttttaataggcgcggggcttttatggatggcgggacatctgcaaaaggatacagcgtcaaatgcgggctgaccggcagcgatcacgatttcttctaaatttaaccttctcgtattcttaaaagaatgatacgatatggctagaaatcaggagaaaagagagtgaccatggtacgtaaaataatcggatggattttgctgctcggcattatcccgttgtgtgcatttacagttattgcttccggcaaagaggtaaaacaaatcaagccttttgatcaggtgctcgataaacatattgatttaaaagcgatcaacctggttcaaaacagttacatgtatgacagggacggaagccttgtttctgagattgtcagcgatcatgagaaccgcgtgatcgtgccctttaataaaataccgaatgaggtaaaacagctgtttttaacctctgaagaccgccatttttatgagcataaagggtttgactttatggggatggtcagggcggccgcctccaatttcaaagatcataaaattgaccagggcgccagcaccatcacccagcagctggcaaggaatgtgtatttaagccatgaacgcaccttcagccgaaaactgacggagcttgcctattcctatcagcttgagaaaaaatacagcaaagatgagattttagaaggctacttaaatacaatttattttaataacggcgtatacggtgtcggttcagcggcacaattttatttcagcaagccgctgaaatctctcactttgggagagatggcctttatctgcgccattcctaataaccctacattatatgatcctctcaagcattttgattatacgaaaaaacgacaagtcagattgcttaacggattgaaaaaagcaggcgttatatccgggaaacagctgaaaaaagccgaaaaggaaaagatcaagcttgatataaacgaaaaaacaaataaatatcctgactatgtttcctatgtaaatgatgaattcacacagcttgtttcctcatccgaaggctatgacaagcgtcttgaaaaagcttccggaaaggcgaaacaaaaaatacagagtgagctttccgacagagtcagcacattgttaaaagacggcgtgaagatttatacggcgctgaatccgtatatgcaaaaccaggtcgtcgcccaagtgaatcaaaatctgccgtatgcaggcgtccagggcggagcggccgtgattaatcatcagacacatcagattatcgcgctttcaggcgggaaagattatcataaatatgatttcaaccgcgcctatcaagcatacagacagcccggttcatccattaagccgctgcttgattacggaccttacattgaaaagaccggcgcaacgccacacagcaagattgacgcaagcaaattctgcagtgcggattactgcccgcagaactataataaccgcacgtatggcacggttaccctggaaacggcgtttaaatactcgtacaacacaccggccatcagaatcatggaccgcgtcggcgttaataaggcgttcagctaccttgaaccgtttcatttcgcgaagctggtcagcgcggattaccgtctgcctgcggcgctgggcggttttacaaacggcatgacgccgcttgaaatgaccaatgcgtacaccacgttcggcaacaacggcgtttatacgccgagtcacgcgattacaaaagtgactgatttaaaaggaaaaacgatattaaaatggaaagatgagccggcgcaggtattcagcgtgcggaccaacatgcagatcaaagaaatgatgaaagccgtcgtcaaaagcggaacaggaaagaaagcgaactttaaagctccgtacgtcggcggaaaatcaggaacgtcaaatgactatcacgatatgtggtttgtcggcctgacggatgcttatacgatgggggtatgggtcggcaaggatacaccgtcaagcgtcgaataccttcatgacgcaagccctcagctttcgatctggaaaaacacgctgcaggcagcttattaaagataacggaggggatccgctttgaaaccagctcagcttccggaccgcgtgcttttgtttgacggcgtctgcaacttatgcagcggcgccgttcaattcatcattaaacgcgatccggccggcaaaatctcatttgcttcattgcaatcagataccgcccgggagcttttggcatcagaaggacttccgacagaacaatttgacagcatgattttcatcgaaaacgggcggatatacaaaaaatccgcagccgtgttaaaggtttcccgtcatctccgcggagcctggcggctgtcagcgatttttttcgcagtgccccgccccctcagggacagagcctattctttcatcgcccggcgccgttacaaatggttcggaaaaagggaagcatgtatgctcccctcccctgagatcaaaaacagatttctgtcttaacaaaaatggctagcttacacaggtaagctagccattatgctattataaagcttgataaagatgtacaaaataccgataacaaaagtaaaccaaaacagaatctcaagcaatataaaaccgatcagcgaaacaatcgagagtgtcgaatagattctgtacaccatgaaaatcaaataaacgagcgtaacaacggcaaataacgccgcaatccaaaaaccattctgcacgagcgcaaaggaaagaattcctccgcctacataaattaaagagcctaatctgatttttttcagattgtccccttcagggtcatttgtgaaaaacaaaagagacagctctgtcactgtgtttgcaatcagcttcaaagccgaaaaaagcataaaatacacaagggcgaacgctgcaaaaagcgccagtctgatccctttctcagagaaataatccagcatcccctgatacatgccgagcgtctgaagtatcttcatgacataaagcgaggtagaaatggataatgacgaactaaaaagcagaatcgcaacgagcggaaaataacccgtccaataagtatttttcatataaaaagtccctttctgtaatctacctcacttattatggaggacttaaaacacattgacaagataaaaaattccatttttcctcacttttacgaaataagggcctgatcttcacaaacaggctttttcggagtaaagtagaacgcgggaatgataaacgtaaggaaggctgttatgaaaaaaacattaaaattgcaaacccgattaacgatattcgtctgtattgtcgtccttatcgcactttgtatcacctttttcacgatcagcgtccagacagcagaccgcgtgaaagaagaagaacggacaaccgcgctgcgcaccgcaaagctggtcgcggaaacaccgagtgtcgcgcaggcaatgcaaacaagaaaagggctgaaagagctccggaattatacactggatgtccagcatacgacaggaaccgaatttgtcgtggtgatggatatgaacagcatccgcctcacccaccccgacgcaaataaaatcgggaagaaattcaccggcggagacgaacagccggcgttgcacggccatatcaaaacgagcacatcagcgggaactctcggaaaatccatgagagccttcgtaccgatctatggaaaagataaaaaacaagtgggcgtcgtttcggtcggaatttcgcttaacaaaatacaggatgtcgtcagccacagtttgagaccgctttatttcatcatctgcgtaagtatttttgtcggcgtcatcggagccgtcattgtcgcccgcaccgtcaaaaacattatgtacggtcttgagccttatgaaatcgccaccctcctggaagagcggagcgccatgctcgaatcaacgaaggaaggcatcctggcggttgacgcgcggggaaaaattaagcttgccaatgcagaggcgaaacgactttttattaaaatgggtattccgactaatccggtcgatcaagatgtgaacgatattctcccgaaaagccggctgaaacaggtgattgaaacgaaaaaaccgcttcaggacagagatatccgcattaacggacttgagctggtctttaatgaagttccgattcatctgaaaggacaaaccgtcggagcgatcgccacgttcagggacaaaacggaggtcaaacatttagcagaacagctgtccggtgttaaaatgtatgcaaacgcattaagagcccagtctcacgaattcatgaataagcttcatgtcattttagggcttgtccagttaaaagaatacgatgatctcggcacttacattaaagacattgccattcagcagaagacggaaacaagcgagattataagtgatgtcaaaagtccggttctcgcagggtttcttctgggaaaacaaagctacatacgcgagcagggcgctgatctggacattcagctcggcagcctgattccgaatgcggcggatccggccgtcatccatgagctcattacgattatcggaaacctgttaaacaacgcgctcgacgcggtggcgcagatgccgaaaaaaaacattacgtgctcgatgcggtttcaggatcgccagcttgacatagagattacggatacgggagccggaatgtctgcggcagaccaagcccgtatttttgaacaaggttattccacaaaagggacaaaccgggggttcggcctctatttcacccagcaggcaacagaaaatttaaaaggccatatgattgtgacaagtgaaaagaatgaaggaacgactttcagtcttcgcattccgtatgaaccgaaggaggaaaatgatgattaatgtactcatagttgaagacgaccccatggtgggtgaattaaataagcgctacctcagccagattgaaggattccagctgaaagggatcgcatcatcctttcaaagcgcgctgcacgtgctgagcgagcatcatatcgatctcatccttcttgacatttacatgccgggaaaaaacgggcttgagcttttaacggaaatccgcaagcagaatgaatcggttgacgtcatcgtcatttcggccgcaagcgagctggacgtcattaaaaaaacgcttcggtacggcgccgtcgattatttaatcaaaccatttgaatttgaccgctttcaaaccgctctttccgactacagacgcaagcagaaagtttatcaatcacacagaagcatgacacagaaagaattggatgccgagctttttcaaaagaaagaagcggcggaaaaggttcaccttccgaagggattgacaaagagcacgcttaaactcatctgggcgagtattgagtctttcggcgacggctcttttaccacggaagatctcgccaagcatactgaaatctcgcaagtctccatccggaaataccttaaatttctggaagacatacaagtgctgaatgtagagatggcgtacggcacgatcggcagacccgtctttcaatatcatatcaacaccggcaatgtcagcagcatcaaacaatatttataatgtcaaaaagcgccgtttcgctgtgaacggtgcttttttactgtcatatcccgtgacaaaaggcttgagattcctttttgatatgctatataaggataatgacccggctgatcctcctctgttttaaccagatgaggaagccgattcataaaattgatattttttaaaaaataagcaaatttctatttatttatggcgggtaaaatgataaattatgattggttagcagatcttttcagataagtcataagtcccgaacccggaagagacagccgctcaaggcgggaaaaaaagagacgtctcatcattattatcagaaagtttttttgattctgcatccggcacggggactcaagtctgaattgaacggcacagccatattttacaggggggttatatctttgaaaaaacgcaaaatcggaatggcgatggcgctcatcgcagcggccggaaccatattaagcgcatgcggttcaagtgacaaagcaaacggctccggcagcaaaaactttaccgtcggcatggtaacggatatcggcggtgttgatgacaaatcatttaaccagtccgcctgggaaggcatccaggcattcggaaaagacaacgggcttacaaaaggcaaaagcggttttgactatcttcaatcaaaatcagatgcagattatacaacgaacttaaataaattagcgcgggaacactttgacctgatttacggcgtcgggtatctgatgcaggattccatcagcgaaatcgccgatcagcgcaaagacacaaattttgcgatcattgatgccgttgtcaaaaaagacaacgtggcgagccttacatttaaagagcaggaaggctcattcctcgtgggagcggccgctgcgctatcgagcaaaacgggaaaagtcggattcgtgggcggaatggagtctgaattgatcaaaaaattcgaaatcggcttccgcgcgggtgtacaagccgcaaatccgaaagcgaccgtcgaagtgaaatatgcgggcgggtttgacaaagccgatgtcggcaaggcgacggctgaaagcatgtacaaatcaggcgttgacgtcatttatcacgcggccggcgcaacgggaacgggcgtcttcacagaagcgaaaaatctgaaaaaagaagatccgaagcggaacgtatgggttatcggtgttgataaagaccagtacgcggaaggccaagtcaaaggcacaaaagacaatgtcactctcacatcaatggtcaaaaaagtggatactgccgtggaggacttaacgaaaaaagcgagtgacggtaaattcccgggcggcaaaacattaacatacggtttggcgcaagatgcagtcggcatctcggatcataaggagaacctttctgacgatgtcatcaaagcaacagacgattggaagaagaaaatcgcggacggactcgagatcccttcaactgaaaaagaattgaaatccttcaaggctgagtaagaaccaggggataaggagacttccgtgcttatcccctctcttttttgaaaagagcggtgaaggaaaagctgcatctcttgcagcttttcttttgccaagctctttctcatcaaagtatctctgaaaaggagcgacaaatcggtggattatatcattgaaatgcttaatatacgcaaggaatttcccggaatcgtcgccaatgatgacgtcacgcttcaagtgaaaaaaggcgaaatacacgcccttctcggtgaaaacggcgccggaaaatcgacactcatgaacgttttattcggcctgtatcagccggaaaaaggcgagatccgggtgcgtggcgaacgcgttcacatcaacagcccgaacaaagccaacgatctcggcatcgggatggtgcaccagcattttatgcttgtggataccttcaccgtctcagaaaatatcattctcggaaaagagccgaaaactttcggccgaattgacagacagcgcgccgcccgggacgtgcgtgatatttccgaccgttacggcctgcacattgatcctgaagccaaagttgccgatatctccgtcggtatgcagcagcgggcggaaatattaaagaccctctaccggggcgccgacattctcatttttgacgagccgaccgcggtgctgactccgcacgaaattcaagaactgattcagattatgaaaaatcttgtcaatgaaggaaaatcaattatcctcatcacccacaaattaaaagagattatggaagtctgcgaccgtgtcaccatcatccggaaaggaaaaggcattacaacacttgatgtcgcacatacggatcaagatgaactggcaagccttatggtcggacgcgaagtgtcattcaagacggataaacagccggccgaaccaaaacaggaagtgctttcgctttctgatgtaacggtgaaagacgcgcgcggcgttgaggcggtcaaacagctctccctctctgtcagagccggtgaaatcgtcggcattgcgggcgttgacggaaacggccagtctgaattaattgaagccattacaggtctcagaaaaacaaatgccggcacgatcatgttaaacggcaaacagctgcaaaacatgccgcccaggaaagtcactgaagccggcatcgggcatattccgcaggacaggcataaacacgggctcgtccttgattttccgatcggagaaaatatcgtgctgcaaagttattaccaaaagccctactcttctttcggcatattaaataaacacacgatttatgacaaagcgcgaagcctgattgaagaatacgatgtcagaacacctgatgaatatacgcctgcgcgcgctctctccgggggaaatcagcaaaaggccattatcggccgggaagtggacagaaatccggatcttttaattgcggcccagccgacgcggggactcgatgtcggcgcgattgaattcgtccataaaaagctcattgagcagcgtgatgccggtaaagcggtgcttctgttatcttttgaacttgatgaaatcatgaatctcagcgatcgcatcgccgtcatctttgaaggcagcatcatcgcaaacgtcaatccgcttgaaacaaacgagcaggagctcggacttttaatggcgggtagtaagcaaatggaggcggggaaaacacatgattaatcgactttctcatctggctgtgccgctgattgcgatcatccttggattagctgcgggtgcggtcatcatgctcgccagcggctacaatgtcgtaagcgggtattcggctctttggagcggcattttcggtgaagtgtattacatcggggaatcgatccggcagattacgccatatattttgtccggattggccgtggcatttgcatttcggaccggcctttttaatatcggggttgaaggacagctccttgtcggctggaccgccgcggtgtgggtcggcgcttcctttgacgcccccgcttacatccaccttccgctttcattattggcggctgcggctgcgggcggcatttggggcctgattcccggatttttaaaagcccgtttttttgtccacgaagtgattgtcacgatcatgatgaattatatcgctcttcatttaaccaattatctcatttccgatgtcatgacggaccaccgggacaaaacagacaaaattcatgaaagcgcgtcgctccgctccccgtttttagagcagctgacagattactcccgccttcattggggcattctgatcgctctgtttgcggcagtcctcatgtggtttatcattcataaaacaaaaagcggatttgaattccgggctgtcggctttaaccagcacgccgcacaatacgccggaatgagcgtcagaaaaaatatgatgtacgccatgatgatttccggcgccttcgcagggcttgccggcgcgatggaaggactcggaacctttcaatatgcggcggttaagggcgcctttaccggcgtcggcttcgacggcattgcggttgcgcttctcggcggcagcacggcaatcggcgttgttctggcggcatgtcttctcggcggccttaaagtcggggcattaaatatgccgattgaatccggggtgccttctgaagtcgttgacatcgtcatcgccattattattttgtttgtggcatcaagctacgccatccgtctcatccttgataaattgaagaaaaagggggcgaagtaagtggacttcctgcagattttatccattattgtcccggcaactctcgtatatgcggctccgcttattttaaccgctctcggcggcgtgttttctgaaagatcgggggttgtcaacatcggtcttgaaggactgatgattatcggcgcctttacaagcgtcatgttcaacttatttttcggacgcgagcttggcgccgccgctccgtggctcgccttggctgcggctatgattgccggcggactgttctcactgatccacgcggctgccgcggtttctttccgcgccgatcagacggtaaccggtgtggcgatcaatatgctcgcgttaggagcaacactgtttatcgtcaagctgatctacgggaaggcgcagactgataaaatcccggagcccttttacaaaacgaacattcccgggttaagcgatattccggttttaggaaagattttcttttctgacgtatattatacgtcgattttagccatcgtactggcctttgtttcctggtttattttattcaaaacgccgttcggcctccgcatccgttctgtcggggaacatccgatggcggccgatacgatgggaatcaacgtgttcggcatgcgctatatcggcgtcatgatcagcgggctgttcggcgggctcggcggcggtgtatatgcttccacgatcgcgcttgatttcacgcactccaccatttccgggcaaggctttatcgctctcgccgcgctggttttcggcaaatggcatccgatcggcgcgctcggggctgcgctgttcttcgggtttgcgcagagtttgagcattatcggctcgcttttgcccctgttcaaagacattccgaatgtatacatgctgatggctccttacattctgaccattctcgcgcttgccggcttcatcggccgagcggatgcgcctaaagccaacggcatcccttatattaaaggaaaacgctgattgtgacacaaaaagagttccgcaccctggtgccggaactcttttcatctatatacgattctgatatactcacgcggctgaaacggcgtttgcattgattcagccgcactcagcttgtcttctgcgtattccgcaccgagaaaaaaacgctcccaatcatctgcctccgtctgctgcaacgttttgcagaaatcatccgctatgaatgttcctgcaataatagaacaaaatattccaatacaggccgccgcctttctcttcatctgaccagctccttttgtaaagcttgatctgaaatagaaatgtatatacaaagatccggatatttgataaatttattttgggttcaaaagaccacaaaaacacaaagaggaatacattatgccgtagcagggtaaaaaaaagtgcgatataatttgtactgggtcctatgaccgtgaattgattgattcattcttacataaagcagttgcttgatgaaaaaacaagcaaaggaggtcttctgttgcagctgttacatttcgcgattttggcgccttttttatttgcatttatcgttccctttctttataaacgggtaaaacaagtccatacaggctggtttgtgctgatagtgcccgttgtgctgtttgtttactttatcagcaagctccctgtcacaatggctggggaaaccgtccggtatgcggccgaatggattccgtccctcggtattaactataccgtttatattgacggactcgggctgttattcgctttattgattacgggcatcggctctttagtgacgctttacagtattttttacttatcgaaggacaaagaaaagctcggccccttttatgtgtacctgctgatgtttatgggcgcgatgctcggcgttgtgctcgtcgataacgtcatcgtgctttatatgttctgggagctgacaagcctgtcatccttcttattaatcgggtattggcataagcggaagaaatcacgctacggggcggaaaaatcactgctgattaccgtcggcggcgggctgtgcatgctcggcggctttatcctgctgtatctgatgacggattctttcagtatcagggaaatggtcaaccaggtgcatattatcgcaggccatccgttctttattccggcgatggttctcctgttattgggggcctttacgaaatcagcgcagtttccgttttatatctggctgcctgatgccatggaggcgccgactcctgtcagcgcctatctgcactcggctacaatggtgaaagcgggtatttatttgattgccagattcagtccggtttttgctttttcacccgtctggttttggacggttgcctcagtcggtctgatcacgatggtatgggcttcctttaatgcgattaaacaaaccgatttaaaagcgattctggcattttccacagtcagccagctcggtatgattgtatcgatgctcggcgcaggagccgccgcgcttcattatcagcattcagagtattttacggcggctgtcaccgcggctgtgtttcacttaattaaccatgctacttttaaaggaagtttatttatggcggtcggcattatcgaccatgaaacgggaacgcgggatatccgcaggctcggcggcctgatggcgcttatgccggtaacgtttaccgtttcactgatcggaacgttttccatggccggcctccctccgtttaacggctttttaagtaaagaaatgttctttacaagtatgctgcggattgctcatgcagatattttcagcctggatacgtggggcgtgctgttccccgttctcgcatggatcgggagcgtcttcactttcatctacagcatgaagctgtttttcagaacgttcagcggcgcgcgtaaatctgctcagcttgaaaagacgccgcatgaagctccgctcggcatgctgatttcgccggtgattcttgccgcttgcgccgtcagtctgttttttgccccgaacgttttgtcttacagcctgattgaaccggcgatgaactccatttatccggctctgttaaccggcggagatacattccatgtccatatttcccagtggcacggggtgacggctgaggtaatgatgaccctcggcatcatcattgtcggcacgatcggttacgtaacgctgtctaaatgggagcgtctgtacggtctgtttccgaaaaaactgacgctgaacaagctttacgatgcggtgacgggcagtatggaaaaaagatcttaccagctgacgtcatcttatatgaccggatttttgcgggattatctgctgtatatttttgcggcgtttatcattctcatcggagcggcgttcgtcatgaaaggcggcttttccatgacagcgaaaggcatggctgagatcggcctgtatgaaatcgtgctgtccctcgttatggtgagcgcaacgattgcgactgtgttcgccaaatcgcggctgacggccattatctcactcggtgttgtcgggtacacactcgcgctgtttttcgtgattttcagagcgcccgatctggcgctcacgcagcttgtcattgagacgatatccgtcgccttgtttcttctttgtttttaccatctgccgaaaatgcggcggaaaaagaagacaagaacattccggatgacgaattttatcatttctctcggtgtcggcatcatcgtgacaatgctcggaatcgcgtcttccagcgaaaaaacaaaagacagcatctcctcctttttcaccgcttacagccataagctcgggggaggaaacaatatcgtcaacgtcatcctcgttgatttcaggggatttgacacgatgtttgaaatcacggtgctgtcgatcgccgcactcgggatttacggcatgatcagaacaaaagtaaaagaggagggagaagagcgttgagacagcaaaaaacaaacgacatcatccttcagacggcaacgaaacttgtatcttttatcattctgcttttctctttctatttatttttatcggggcataacgctcccggcggaggatttgtcggcggattgattacgtcttcggccatcgtgctgctgcttttggcctttgatttaaaaaccgttaaatcgattttgcccgtcaattttatttatgtggcgggcgcgggtctgcttatcgcgattgcaacgggtgcaggttcattcttattcggagtgccctttctcacccatacattcggccattttcatctcccggtgctcgggaatacggagcttgcgacggccactttgtttgatttaggtgtgtatctcgttgttgtcggcgtgacgatgaccattattcaaacgattggagaggaagaatagtggaaatcttaatgtctgtcattgccggtattttgtttatggcggcaacctacctgctgctttctaaaagtctgctgcgcgtgattatcggcaccgcgcttttgagccacggcgtccatttgctgctcctgaccatgggcggactgaaaaaaggcgctcctcccatactgggcggaaaaagcacgtcgtttgtcgatccgctgccgcaggcactcatactgacggcgatcgttatttcgttcggcgtcacgtccttcctgcttgtgatggcgtttcgcgcctatcaggaactgaaaacggacgatatggatcgaatgaggggaaatgatcaacatgaataactttgtgatattgcccattctggtgccgctgcttgccgcagtgctgctgatttttatgaacaggcacgtgatgctgatgcggatattcagcactgccgcttcctgtgtctccatcgtcatcagcgccgctctcgttcagacggttttcacacacgggattcagacgctgacactcggtggctggaaagcgccgtacggcattgtgctcgccgcggatcagctcgccgcactgcttgttttgacaaccgccataatcgggctgctcgtcatcctgtactccttccgctccatcggagaaaaaagggagcgcgctttctattattcaggggtgcagtttcttctggccggcgtaagcggagcgtttttgacgggtgacctgttcaacatgtacgtcttttttgagcttctgcttatcgcgtcctacatgctgatcgtgcttggcggaacgaaaattcaattaagagaatcattgaagtatatcgtgtttaacattgtgtcatccgcgttttttgtcatcggcgtcggttacttatatgcggtgacgggcacgctgaatatggctgatctaagcgtaaaaataagcgaatcgggccagaccgggctaataaccgtgatcagcgtccttcttctcgtcgttttcggtttaaagggcgggatattcccgctgtatttctggatgccgggctcttattacgccccgccggctgcaatttcagctttattcgggtctcttttaacgaaagtcggcctgtatgccattttaagagtattcaccctgatctttattcacgatacgggctttacccaccaattgatgatgtggcttgcgatgctgacggtgctattcggcgtaatcggatctatcgccttttcggatgtcatgaaaatcgtcatctacaatattattacagccgtcggcgtgattttgttcggcattgccatgaacacgccggcctccattcaaggagcggtttattacttgattcacgatatgctgattaaaggagcgctgtttatgcttgccggcacgcttatcgcattgacaggcactgccagcctgcataaaatgggcggactgatcacccgttatcccgttttaggatggatgttctttatttcagccatatctttggccggcatcccgccgttcagcggatttgtgggcaagctgaagatcgcggaaggcgggttcgataagggggaaacattgttttccgtattgattctcttatcaagcctgcttgtgctctattctgtgctgaaggtttttacgacggctttttggggggagaaaaagaaatccccggcgcaggcggacggtccgcaaaaggacttctttatccggcagccgcttttctccttttgtcgcttctgttcgggctcggaaccgaatgggtttcgccgtatgtcaatcagacggctgagaatctgctgaatccggaaaaatacattgaagctgttttgaaggagtagatggcatggcttttcaacttttattaaatgttcttctcgctgtttgctggatgtttctcacaaacagcctcagcacggcgggttttataaccggatttatcgcgggcttggcggcgctgttttttttccggcgcttcttctcgcggccgttttacatttggaaaatatggtcggtcatcagactggcgctgatctttataaaggaattatatttggccaatgtcagcgtgctgaaaaccgttatatcgccgaaactgaacatccgcccgggcattttcgcgtttaagacggaattgacggaggattgggagatcacactgctctcgctgttaattactttaacaccgggtacgctcgtgatggatatctccgatgaccggtcgattctctatatacacgccatggacattgaagatgcggagaaagcgatccatgacatccgcgtctcttttgagaaagccattcaggaggtgagccgctgatgtttacgtttattctgcaattatcactcggcattatggcggtttcgactcttctgtacgtcattcgcgtcatgaaagggccaacgataccggaccgggtcgtcgcgcttgatgggatcggcattaatctgattgccatgaccgcgcttgtatccattctcttaaacacatcggcctttttggacatcattctgctgctaggcattttatcgtttatcggcacgattgcctttgctaagtttttggagaaaggagagattatcgaaaatgatcgaaatcgttaaatgggccgtcgccgtttgtattctgatgggatcgctgatctgcctggtcgcgtctttcggcacactcaggcttcctgatgtgtatacgcgcgcccacgcctcttcaaaaggctcgacactcggcgttaatttggtattgctcggggtgttaggctacttgtggatgctgaccggagaaatttctgtaaaaatactgctcggcatcatttttatcctgctgacggcgccggtcggagcgcacctcatatgcagggcggcgtacaattcgggagcggcgcttgataaaagaagcgttcaggatgattacaaagggatcagaaactttgtgatcaaacgaaaagaagattcatatttgtaaaaacaaacagccggacgattcagggttccggctgtttgtttattttgttataacagccagcgtgcagcgggaaacacagatcagcctttctcgttcatcgaaaatgttaatcccgtacacaatggttgccctgcctgtgtgaacgggttccgctatcgccgtgaccgttccgccctctttcacggactttaaatgattggcattaatctcaagcccgacacacgcctgtttcgaccggtcgataaaatgctgggccccgacacttgcaacagtctccgccagcgctgctgacgcgcccccatgcagatatccgaaaggctgcaccgtcctcttatccaccggcatcaccgccacgcatctctccggcgtgttttcagtgatttcaataccgagtgcgccgagcaatgtattgttcagattcataggtcattctcccttcaagatttatagtacgttatctgacttggcgatcagcaccgcttcagtacgggagccgacattcagcttattaaaaatggatgtcaggctgtattcaatcgaccgcttgcttaagtgaagcgcatctgcgatttcctgattggtcaaacctttttcgacctcttggagaatatggcgctctctcggggttaaccgatcctgctcactttgaggggaagaagacgtttttgttttttgctgggtcatcagctgtttgaaataggagaaatcaactaaaatctgtccgttgagcacgtgatatatgtattgcatgattttctctttagattcggttttactgatggcgccatgcaggcccgcgcggatggattcttcaaaataatcttcaacctcatagcctgtgtagacaatgattttacagagaggattctcttttaagattttcttggaaagctcgatgccgctgatgtcatcacccagatttaaatccattaatatgagatcgtaagctgaaaaatcatgccggagaacgaattgttcactggcatcaggactgaggcaatcgacagaaagattcgtgtccgtttccagaatcgtcttggtgccctccatgacagccggatgatcatcaatcactagtatctttttcatggtttcctcccttttactcactcatttccattttattaaaaagacttggcttctgccaagtcgatttggtgataaattggttacaattccatttcaatatccgctttaaaaccgtttccttcacttgtgtcgattttcatccgtccgtcaagcgcacggacgcgttccttaatacccgaaagacccatgctcatcgactgtccgccgccttcttcctgattgcagccgacaccgtcgtcttcataatgcagaatcactttattttgaatgctgatcagcataatcagcacctcattcgcctgtgaatgcttcatggcgttcgaaagaaattcctgaataatgcggtacaaattcagctgcgtatccaaatccagcgccgccgtaaaccggcccgtattcagacggatatgaaacggcgcacgctcctgctgctgcgcggcaagcttggataccgccttgaccagacccaaatcatacagcagctgaggacgaagctcatggcacgtctcccgggtcatcaaaataacatccgacatctgctcattcatctgatgaagcttgtcctgcacctctaactggcaaggctcttctcttttaaaatcagccagaaacagctcacactgacgcttcaaagaaatcaagtcctgcagcaccgaatcatgcagatcacgggctaaatccgaacgctgcttttcctcgatcgtaaacatcagctttttgagccagaccgggtttgagccttgttgtttcaggtcttgtaaatggttcatgagttcttcgatctgcaatatgttttccatcgaaacacttgtataaaaagacaatgtctttaaccaagatatctcatctcttgtcagtctcggagtattaatgctcgacaaacaaagcagaacgtatgagtttgcccctctttctccaatcttcatcagaaaaccttgatttacttcaaaaatcttgccaatctctgatgtgactttatcaaattcttttttatacggctgccagttcggttcactgttctgtttatcaaaatacagaatgtctccgtcagaattgatttcaaatatataagctttactaacaggcaagacgtccaaaatagtctttttcaaattcataaacacttgatttaaagctgatacgcttttaagaagctgtgtatatttataaatgctgtcttgataattatatttttctgaaaaacgtttcaggcgaaatttgtagtctaataactccttaatataaaataccgctaaaaaaatcaaaaatacatatacagtgatttgaataatgttaaagttattccccttgctgtcgaataatatattcagccatacaactccaatagtcggaataatggaaaggaaaccatagtacctgattctgcccaacaagaagtctatatcgtagattttattgaccacgaattgatagactaaagctaatggaataattattaaaaatggtgccgtaactatagcagaataaatatactgtccgaacaacacctcaggtataatataaaatactgtaaacggaaaaaaggctatggtattagatataagtaacactttcagcaaataaaagtgatccttttttcggtagactagtccataaaaaataatggatgtatagacgaccatcatttccaaaaaaaatgttactaaattaatattcgtaacaagttggaaggcaaaatgcttctggaatatctcgattattatattaataaccggcaatatatagagagtagacacaacataaccagctgaaaatttcaattttaattctttaaagtattgatacaaaaagtgaaagtataatacaggtacgttcaaaaatgtaaaaaggttaatatatctgtttatttcatatcctctagttactccacctgcgcttaaatatgcaatggatgtacacaataaaaaaataatcaaaatataggctgaataagtatcttttactctgttaactttataaatataaaaaatgcataacatgcttaaagcaaataatatgcatgggataatatagataaaaaaactataagagctatttaaggaaataaactcagtattatgtaagtctattttactattaccccttattattttcatatgttcagctttcgctagatattgacctcttatattctcttctgtcggtgtttttccgcttatttcaattatcctgtctccctcttttaagcccatatatttaccatacgtagacttggagagttttacaacctgcaattcatggttattgttttcaaccacataggttcctaccaaaattccgttttgagtaaaatatataatatgagcgacgtaaaagagactgacgaataacaatacaatcgaaaaatttctaatgaattttttcaatagatctcactctctcaatcattgttcccaaaaaattcccctgcatttttttgattgacttaagtctctttcaaaaatctcaacaatggcaggtaacagtttatccggaactcctattaaactagcttccccacacgctaactttgtaagtacaagtggattttccataagataatgtacgatatcttgcttcactgtaatttcctccattaaagttctaacattatatttaaatcttttatacttgtcgtaatttcttcctcgtacattttaattaacattgaaacatactggctaactcctgcatcaaatagcaggtcttcaaggctttttttattatcaatgaggaatgaatggtaacttgcttctgcattcattaaatccaagattttttctgaagcagcattaaatcttcgctttagatacaacagaattaatgtttttcttccctttctgatatcactacgatttttattaaaaagaccataataatcattttcaatctgtttaacaattccaattttataagaataattctcaatttcttcgttaaactccccatttgcaagcattgttcctaatacagctgacattgcagtaagcgagcctgatttttgtttaatcatttgaagacattcgtcttcagtttcggggaaattttcgaggtcattatgctgaccttgcattgcatttaaagcatatttcatagcaagccggggaaaatcggagttcgttttaagctcacaaatcacttgaagacttattgaataaagagaagtggctgcatttaaagagatagattgatctatcttcatccattccttatccaagttatcttcatcctctatatcgtcaaaaatatcaaaagctaaaattaacaattcaattcctgaagccaataacgtaatatccgaataatgctcaccatcgaaagccacataatgcttaaatgcaagaacaccaaaagcaaaatgatttttttcatttataaaagtctgaagggtgtcttttaaatgtggattatttattttctccccaacaatttccttcatcttctctttaatcgtttcggcatctaaacacatttgctcaataattgtcttcaccctcccattctattttactaaatgcaggtgatgaaagacagcaggttttttgttttttaacaatcgtataatactttatccatgaaatggataaaaaatgcacaaaaaaaagacttgtttccaagtctttttaagaaattttcattgcatatgagaatttatcgagctgatcaatgcttttgttaatgtttcgtaatgagtcggttgtttctctgatatcattttcaagtcggaataataattgctttacttcttctaatttgttttccaccgtttccacactcctttttttgaaagatcaatgaattgtgtatggtgaacgagtcctaggtatttgatctgttactaatagtgtaaacgtttttgcgggatttttcaccgaaaagtatgtgtaaaagtatctgcgtgacaccgcaaaccatggtaattccatagtcccgaacagggcatttagcgaacgggactatataactaccacaaaggcagacgtttaggataaagcagaccaatctggcggttctgctgttttttcaacggttttccgacaaaccggcagggactatagtccctgccgtcgcaatttcaaaacagaatgggcgaacagcgtcgcataaccaccgacaaacaccgaaaagaccgcaaccccgcattgtggtctttttgcatgtcataactcgttatcacgccgcctatactcatgtataacgaatgttttctcaggaaggaggccgccgtatgcattatgtgtatccatgctgccctgttttcgccgcgccataccggcatccagcgcccagtgccccggttcacgcagatattttgacagcgtccgcaaaagaagctgcgggcatgctggaggatgcgcgcctgctccttgcgcggctgtcggcgtcaaaagagcttgcgcgcagcatcctcaccgcagcgcaatcatctgacaccgcagcggtcaagcggctcattaagcagaccggcatcaaaaatgactttgacgtgacgtataatcccgacggcatccgtgtcagtctgatcagagagcaaagccggtttatcatcgccctcaggtggtcggcttaaagcggctcaatcgatcagctgccggcaccattcgatcgcctgtaagtaacattcatacgcttcttctttgttcagttcttttccccactcgtcacagtcccagttgttgcattcaatggctttgacgagcgcgagcatcttataataatcgttttcataaccgagcagcgcctgtccgacttcatcgattaaaggcagttctttgatgatatcctccagctccctgtggagaagcgtatcgatgagcgaaaacatgccgatcagcatgtaagaagagggctggggccttccggttcttttcgccagcagttcgcacagtttggccctgattaaggaaatcttaatgatttctttttggcttgagtggcttttcgccgttaaatctctgaatgaaagaatgtaaatcaagcgcttaatctcattcagcccgagcatcatgatggcctgctggatgctgtctatcttttttttcagccttgtttgcgatccgtttaaaaaacgcagaatctgatacgataagctgacgtcccgctctatgtattccgtcacgcgctgtatattaggctggtcattgtttaattcgcttaaaagctggtagtaagaatgaaaatgaaacgtcagatcatttccgctgatgacacgcggttcactgaaaaaatatccttgaaacaggtgaaagccgtctatggccgcctgtttataatcttttctcgtctccactttctccgctaaataaatcagacttttacagctgtacgtctgaatgatttttttgcgctccagacgcgaggattgcaaaaagtcgatttttaaaatatcaatatatttcatcagctgttccactaactcttcattttccggattgatggcgtaaaaatcatcaagtgctaatgtatatcctaatttcttcagctgtctgcatcttgagatgagtgccggagtgatcggtatgtcctcaagaatttcgataataagctggtcaggatcaaaggaggtagggagatctgaaaacatcaggctttctgtaaaattcacaaagcagcgtttcccctcagtcagcttttcgattccgatgttgataaagctgttaataatgagatccgtcgtagctttatctccgtccgcggccgaatagcggttctcttcgctctcccggtaaagaagttcataagcaacaacctgttcgtttctgttgaagataggctgtctcgcaacaaacaccttcattcatttacccccttagatgcggccttcgaacataagtatatcaaataacttgacgaaatttgtctaaatgtgaaaaatattatcacaacaaaaaagcctttccagagataggaaaggccgctttgttttctattcaagttcccgtttcagcttgcttttgatttcatgaatccgctgcatcttgttgctccagcagtcttcgcttaaatcgaccggatattcttccggcttgctgatccgtttgtattcctcccacagaagtttgaggttatcctgcacgtattgctggatgtcggtaatttcgggattatcatagcataaaacgccgttttcaaagatcggctcatgcaagtctttcgcatagaaatcagtgacgaatttgctgacgaacgtgtggacgggatggaacatttttaagcgtttctgatcatttacccgctcgtcataaagcgcgatataatcaccttccgagtggtgattcagcttgttgataattcggtatactctctttcttcccggcgttgtcactttttcagggtttgacgaaattttaatggtgtcggtcagtttgccgtcctcttcaatggcgacaagtttgtaaaccgcgccgagagccggctgatcgtatgcggtaatcagcttcgtgccgatgccccacgtatcgattttcgctccttgggatttcagatttaatatcgtgtgctcatcaagatcgcttgaagcaatgacctttgcgtctgtgaaacccgcttcatcaagcatttcacgcgctttttttgacaggtacgccaagtccccgctgtccaggcggatgccgatgaagttgatccggtcgccgaattcctttgcgactttaatcgcattcggcatgcccgaacggatcgtatcgtacgtatctacgagaaatacgcagtctttgtgggtctccgcatatttcttaaatgccgtatattcatcgcggtacgcttgtacgagcgcatgagcgtgcgtgccggataccggtatattaaaacgctttccggctcttacattactcgtcgcgctgaagccgccgatcaaagccgctctcgctccccacatggccgcatccatttcatgggcgcgccgcgttccgaattcgagggcgtcttcgtcaccgacaacgcctttaatgcgggccgctttcgtggcgattaatgtttggtaattcacaatgttaagcagagccgtctcaatcagctgcgcttcaatcaggggcgcttcgacccgcataatcggttcgttgttaaaaacgagctcgccttctttcatgctgtaaagagatccggtaaaagaaagatcccgtaaataatcaatgaaatcatcagcatagtgcaattccgtttttaaataattcagatcgctgtcggtaaatttgaagttctccaagtattcgattgctttttctaagcccgcaaataccgcatagccgttttcaaagggaagctttctgaaaaaaagctcaaaaatcgcttttttctcatgaatgccgtctctccagtacgtttcggccatattaatttgataaagatctgtatgtaaagacaaactgtcgtctttaaaaccatgctccaccaaaattgttttccccttccttactctgccacttgcgctccgatgctgttcttaaaatgggacagggcccattcatgcccttccggattaaagctggccacagcgttttgatgaatgacgatctgaaagcccttgttgtaggcgtcaaccgccgtgtgaagaacgcagatgtcggtgcacaggcccgcaagatgcagctcagtgatctgccgttcccgcagtttcagctctaaatccgttcccgcaaaagcagaatatctcgttttttccatataatttacgttttttgcgtgtttatgtttctcataaagaggcgatagccttccgtacagctctttgccctccgtgccgttgatattatgcggaggaaacaggcgtgtctcgggatgaaagtcatcgtctgcatcatgcgaatctaccgcaaagacaacgtaatcaccgttttctataaatgcttgcgtcaaactgacaatcgtatcttcaatctgtctcgcgggttctccgcaagttaatgccccgttctcagctgcaaaatcattcgtataatcaatgcatataaatgcttttttcatagccggcctccccgccattcatatgaaaaccattatatcctatctccacttgtaagtgaattggcattgtaaattgacaaacggtgttttgcccttttaagatttcaggagtgagcgctgaaaaatgtcatcctgcacgtaaatgccgtcaaggttcacggcataatcggcggcaaaaaccaggccgagcggcgtttcgaattgaaggtccgagatgacggagcttcggacaccggcaagtgcggcaagcttcatatatggtgaataagcatgatacgggagccttccgtttatatagagcaccgcgtcttttcggcttttcagcgcctgtttcacttcttcatacggctgcttttgcagcacctgtcccttcgtcagggcaatgatgactctttcacgcagcgagcctaaaaataaatggcgttcatccggtttcgtctgcaaaggaccgtacatcccctgctgtaaataaaggtcaaccgttttgtcgctcatcggcctgtccctcccagcttgttttacaattatcgccccggacgggatgcggtaaaccgttttcgttacatttcagccacccaatgggagatctttccggcgagctctccggcgggttcttcttcaatcagcttgctgaatgattgtaaaagccgctgcgccagcgcctttttctcttcctcataggaaatgatcgtgctccactcaagttccggaacggctacaagggtatgctgttcttttttattttcatgcagatatacatcaccgatcattccggactgcacggtaatattcgcttttctgattttcataaaacattccccttttataaagactgattctattatactacaaaaaagcgacagcctcctaaaaggaggctgtcacgcgttaaaccaatcaggttcgtcaaacacatcgatgtcttcaaagcgcgttttgctgaatttattagtaattttgacaaaatctccggaatgaaacgcccctgcccccgcgcctgagtggtcaacggctttgggagaaatggcaaacacgtcaccgaagctcgccgcagcgtctccggctaaactcataatataaatcggtcccacaattgcaggcatacccacacctccgcttttctttacagcattttatgcgctgcaccgggagttgtgcccgtttttatttcggcttgcggctgtcttcgagctttgaccgctgacgaagtttgataagccggacgatatttaagacgaaagcttttaaaaccgcgtaaaccggcacggccaggatcattgcgagaatgccgccgaaactgcccgctccgataagcagaagaataatggtgagcgggtgggtattcagccgttttccaatcacaagcggagaaagcaggttcccgtcaagctgctggacgacaacgacaacaataacggcaaacagcgccttagccggcgaatccataaacgcgataatcaccgcgggcgccgccccgagaaacggccccaggtacggaatgatattggtgacggcgatcaccatcccgagaattaacgcatacggcaggccgatgatccaatatccgataaaacatgccgttccgacaaagagacaaatcagcagctggccttggaaataggcggccaatgtgacatataagtcgttaaatattttccgaccttccgcccggtaggaagaaggcaggattttgaccgccaagagcggaaaccgccggccgtccttcagcatataaaacaaaatgaatggaacagtgatcacgacaagcgtgatattcgtaacgacgccgaacacggccgacaggcttgccgtaatattttgcggaaggctttgtaaaaatcccgtcagagactgctggattttttctatcgacacataatcctgcgtcatcatccacgtaaaccatttggaatgggataattgcgccgtcaagacttgaatctgatgaatgtaatcagggaaattgttaatcagccccgtgacctgggaagccacaatcggcccgatggcggtgaacataaaggcaatcaggccgatgaaaacgagataaatgagcaggattgccaatgtccgggggatttttttctcaagcaggcgcacgatcggattaaaaatgaaaaacaaaatgcccgagatcaaaatcggaaaaaacagagtggtgataaaaccgaaaaacggctgaaaaataaacgagactttcgttgatacgtaaataatgagcaaaacgagcaaaatttgcagcgtccaaaaatggacctttgatttcaacaagcgatttcctcctattgtcatgcgaacttgtactgtgattgtaccaaaaaaagccgccgtgcatctatgtatctcaaaaaagaagacgcaccggggttctatagtgccgcctccggtttgcgccttttcgggctgttacacgcgttcggtataatcaggcatgacggaaaccacatggcggtttctgatataaaatacacggtcatgcgtctcttcaatggcgatgtgatccggagtggcatcaatcagccgtcctctgacaatgcgtctgacggtttgaatgataaaccttgagccgataagcttatggatggtctgataaacgtaaggatccactaacgagacgatttgcgggcttccttgatgggccattttcgctgatcccctttactatgttttccttcagcatatgcagcggacaaaggctttgacacagtacgtctatcggagcggaaaaggtgttagtgagcatgcggagttatgtaagcggaaaaggccgcatgagtggcctagactgagcttcttatgggatattgggctcggtcaattaactgatcaagcttttggatttgtttgagcgcggccgtgtgatccatttggcggtaatggtgatgtccgccgggttcttcatcgagttcatccgcttgtttcacgatttgctggagcgtattcttgtccagttcgccttcaggcagataggaatcggtgtgaagcagaatcgccagcgcaatgtccttcgccgctttcggttcttcaccgagccggatgagcagcttatgcgcccgttccgcgcctttaatggcatggatatcgtttcttctgtacttttcataatcccatttgccgtctgtgtaccattcataatggccgacgtcatgcagtaacgccgctttcgccgccagatccgggctgacacctgcttttacggcaagacggtatgcatgaaacgcgcaggcgatcgcatgggcgacaccggaacgctgtaaatacttttgtgcgattggatgggtgaagacatccattaacgttacatttctcatggaaacccctccttcatatatttttagaatcctaacataaatcgagaagaaactcaattcatctgatacatttcttataccccttatatgttgtttcattcatcatatgccgccggacccctaagtgattgtacaaacaaaaaaagagcagcgtgaaagctgctctacaaaaattctttgatatcgtatatccgtccgttttccggctcgcccgcgatcagtgagtgaatgacgccggcgatgtattcaggacttctgaggtttttcgtttctttcagattgcggaaccgttcgatgtcatggaaatcttcttttgacgaagaacggatgacagcctgcatgtctgtatccatcactcccggcgagaatgagatcatgcggaccggcagctcttcatcttcctgttcaaacccgaatgttctcgtaaacatatcaagccccgcttttgagctgcaatacgcgctccagcctttataaggattttttgccgcacccgatgtgatgttgacaattgttttgctgccgctgaacgcttcgaaacgctttgtgaacatttggctgagcaaaacaggcgccgtcagattaagggtgtaatggcggtttaattcttcggcggaagcctctttcgcccgcttgatcggttccaccattccggcattgttgatcagtgtgacggcggagtaccccttctcctctgcttgatcaagaatcgccttcatctgccgcccggtatctgcgagatcggttagatcaacactgtattctgtcagtccctcgcgcttttccccgcttatcgttcttgaaagcgcggcgacttcggctccttcttgaagcgcctgttccgtaagcgcccggcccaagccttttgacgcgcctgttataagaaaaaactgcatgaaactcctcctttttttcttattttacgggctgtcttcccgcaaacacaagcgatccgtttaccgccttgccttttcctgcgccgtgactttcgggatcagatagatcatcgccgcaatcccgaggaggatcaagacggcataaataacaggaagcagataagaagtctttttctcttccgtttccatatctgccgaggtatgccgcaccgccggctcggcaaatgtgatacccagttgtttcgattgcgctttgatcgtattcggctccgtgtctgacgatgtaaacagatttgatatcagtttgtcatccgggttttcggccggctgatcaaacgtgatatccttctgttctttcggaagcgccgttttttcctcggagtaggcatcgtcgtgcaggtaatccgtacgaatttcaatgtccttcttttcatattcattcggcttgacatcagtattgtcctcattcgcggctgcggcatgcgggagaaaaaggagaaaggagagagcaaacagcaaaactcctttttccacgattgtgttacgcctcataagactgatcactttcctccgttttttccgcaagcagccgaatgatgagcggaagcgccgccgcaatcagcgtaatgatcgcaagaaccgttatgcccatcgcaaacagatggcccgttccgtattggatatcgatatagactttcgaaaccggactgtcaaaggtgaagttcggcataattaggtcgatcaacggcgccacataaaagagaatgagcgcggatgatgcgatccatccggtaattgagccgaagacaaaggctgcccggataaaagctgaactcgccgcaagcaagagaatcgtaaagactgaccatttaatcgtctgatcatccggaagcgaatagatattcagaccgaacagactgatcatcaatccgaccataatgtttaaaatcccaaagagcgcgcctttgacaagaagcggcgcctgctgataatacgagctgaaatagccgatcagaagactgctgatcaggacgatcaccaaaatgacgaccggcggaacattctgaacccggtcttccggcacctctccgctgattttaagcgggttggcgagataatcgtaaacgtagccgttttcctgtccgtcaacgagcgcgttccctaaaatgccgtacacgtcatttctgatcaatttcgtggaattgacgtttttgccccagttgctgttcagggtgtccgctttctgctggacgtcatttacgctttgctgcatattgtcggtatagctgatgatgccggactggcgttctgacagatggcccatcgtgtcagacatttgcaggacttcgcggccgacggtatcctgagcgccgagcgccatcgttccggttaatccgtctccgctgaacacggccgcttcctgcacagcgccttcagccagctgatcggatgctttcgccgcgctgtctgaaatgctggcaagctcattgagcactcccgcttgttcatctctgatatacgagctgtagttatccgagaattcggtcatgcctttaataaaattgctgatgtcttcatctgtctgcattttattgtttttcagattttcccagcttgccgtttcttccggtttgatggcgagaacggtttggacttcgccttgctgggctttcagcacccggtttttcacatcaggcagcgagcccgcgtcaagagagtgatagagtgtcgcctcatacagggataaatcattatagtaactcattaaatcggatatcttttttgtattaatgtcagcggcaaatatctgttcaagagcagatttgcggccgctatccaatgacgggtagttcagaatgttctgttctgttcttacaatcattctgtaaacggtattgaagtcttgttttctcgtttcttccaattctttcagatttttctttaatttatctgcccgttttttgacgtcatcaatctggtctttaaggccctggatttcttcatcaagagcatcgagacgttttttcagttcttcattatgagtctgctgtttctcttccagctctttttcaatttgctgaatgcgttctgcggcttggttcagcctttcttttgcctcagatatgtccgtgccgccgtccccttcagaatcgtttggatcgtccgccggctcatcagcaggcggagtgacgttttcagcggctgtcgcggtctggacggtttttggctcctgatcgcctgtgttatcggaagcaggctgctcttcttttgtgccgtcttccgtttttccgtcttctccgggattcgttccgttattcggatcggtatcgccggagttttcaccgtcatcgccttggcccggtttttcagggtccggactttctttttccggttcttttaatccgtcagaaatgtgattgatttcagcagagatgcgttttaattcttcacgctgatcgtcaaggtcaattttcagatcgccgggtttttcttcttccggtttttcttcttccggtttttcttcttcattcgggtcatccgagccgtcatcccccgggtccttttccggaacggttaatgccggccgatcccttttcataagggtttgaatgctgttcaatgtttcaaatcttgcttgcgctttatattgagtcaaataattgttcagtaaattggattgaatatctgccatcccgtgttcctgctcaggaatctgcgcttctctcacctgttgggcggccaaaagagacgatcccgtctggtcaagctgtgtctgcgcccgatttatgcctgaagacagcccgctcatcatcgtgctgaactggttggcggcctgctgtgctttaatggcgttcaatccggttgtgatttgcttttgattttgttcctgcgcggccatcagcagttttttctgattttcttgatattgtttgtagcgctcgaccgtgtcggcaaagtctttgagcgtggttttggcttcatctgccgaggtcagtttttcttttaccgcgccctgcgcttcattcattgattttttcagttcgtcaatcaggtctttttgccgtttgatttcacctgccaagtcattggagctcggcttgtaaaagttgtacatgacgttttgaaactctgattctttattgacgatcttgtcaaaatcgcctcggacattgttcactttttgtgagacgaaattccaatataatgccgacatttttttattcattgatttttgggcgtcttcaagctcacgctgcactttttctttgttgacggcgttcaggttgctttgaatattgaatgtcagcgtggctttttgcggacgctccttatcatagcttaagatgtcttttgaaaaatcggatggaatgtaaacgacggcgtcatacttcttagctgccagaccgttttcagccgcgctcctgttgacaaccgtccatgaataatccggacggccgccgagagcggccgctacttctttgccgaaatggacggattcctcttcctcattttcatctgtttgtaagcccatgtcttcattcacgactgcgatttggcgggtggcgttgattttttgttttcccgggtcatcgccgataaaccggaaaaacagcaccggcagcagcagaatgatgacgaccgcggctattaatttgatcaggctttttcgttgttcggtcatctgacggcctccctttccgctgaacataaaggtatttggattttttgctccttcccgttttcaaccaaatagccgaagcccggctgaatgtccggttcctgcctttggtaaggcagcggaatgacattttgttcggattttttcacaagcagcatcgcgtggcggatctgtttcatttccgtcgttaaggaatcatagccttttgagaattcgctgtgattgcccgccgggataaaactgaagcccacatgcgcgtaagatttcataaacatcgccagcttgtcctgtatggcggtgtcgatcgtctgctggaatcttgtaatgccgtcggccattaacacgacgggagagaaactgagtttgtgcacatcgccatttttgacggcctgcgcatactgagcttcgcgctccgtgaaaacggcttctgccgtttcgatccactgccggacgtcttcttttgtgtccagatagctgacctttgtttcctgcgcatactgcgacagtccccggtcaatcgagtcaaacagcccgacccgttccgtaccttcacgcagcaggtgattcagcatcactttcaggatatttgtttttccacgctgtgtctggcccaaaataagacaatgtttatttttacccagatcaaagtacacagggctgaccttttcctcatgaagcccgacaggaatgcggaacggttcttgttccgggccgagacggagtgaaaattcgccggccgtcagcatatccggaagcatcggaatcgggtctggaccggctgttccggagtggcgctcagctaaagctttgacatcagctttcagcgcctggaacatctcgaggtcattttccgcttcagccggaagaaacatttgtgcgaaatacagttcttctttttggatcatgacgcggcccgggatcggttcgagactgaacggcggacgcccgtaaatggagtatccttctgactgatccattaaataatggacgactttcgtttttatgttgtttaacagtgactggcggacggcgtttaccctcgttgcggtcagcaggaagtaaatacctaagctttgcccgtcgcgtgaaatctggataaattccgtttctaattcatgcatttcatctttgacgatgtcgaaattgtcaattgtgataaatataaacggcagctcttcttcactgagcgaattgtacattttgatatggctgacttctttttctctgaacagccgtttccgccgctcgatttcttccttgatgcggatcatgaatttttcgatctttctcatttgatccattaagaaatagtctgcggtgtgcggaagctttgccaatggcagaagcgtgccgtttccgaagtcaaagatgtacatatgaagctcttccggcgtgtatccttccgcgaagttcatcaggaaggtgatggcagccactgacttgccgtagccggatgagccgaaaatgccgatgttgccgtcatccatcatcgtgtaagcgagaggcgcctgtctttgctgatcaggctcatcaacgcaggcgatgaagaagcggtctttttcctgcgcggggtaaagcgtgcgcgggatacgttcggcaagcgggggaagccacgggctcggcagcttttcaatgcccatttcattttgaatccgctcgatttcttcgactacggcttctatttctgccggggcgtcttttttcgccgcatcatccgcatccacctcagacagcggaattaagccggtatcggtaacgatagcaatgtcatcctcggtgccgtatacatcttccatgtaaggggcgccgctccaggcagactggaactgctcatacacttcgttatttccgacttgcaagtagccgcgtccggtgaccgtaatattcgccgcatcactgtttttcaggatttctttactgtcacttgcatcctgcactttcagcgcgaccttaaagcgtgagttgctccatatttggtcgtcaatgatgccgcccggcttttgcgtggcgagaattaaatgcacaccaaggctccgtccgatgcgggccgcactgacaagctccctgataaagtcaggctcttcgcttttcagctcggcaaattcatctgaaatcaaaaacaggtgcggcatcggaatatccgtttctccctgtttatacagctttgtataatcattgatgtgattgacgcgatattgatcaaacagccgctgccgttttttcagctcgctcttaatggatgcaagcgccctgatactgaagtttctgcttccttcaatattcgtgatcgtcccgagaaggtgcggcatcttgcggaacggctgcgccattcctccgcccttatagtcaatcagcaaaaacgccgcttcatgcgggtgaaagtgaacggccaatgacaggatatacgtttgcagaaattcacttttcccggagccggtcgttcccgccagcaatccgtgcggcccgtgcgctttttcatgcaggtttaaatagacgatgtcgtcttttcctttatagccgatcggaacagccagcgattttgcagactcacttgtctcccacttctgcctgatgccgatttcttttacttccttcgcatgaaacagctcgagaaatgagaccgtttcaggaatggaattcgtcattccgacctgatggtgcaatgtccgaagcgtccgggaaaaccgctcgttgtttgtccgttcatgcctgtccagcttaaacgggatctgcaccgcttttttctgctgaatgagaatgtctccctcatcttcattaatgtagcggacgagggtgtgaatgttttctgccaggctttccttcgtttccgcggcgatgattgccgagatgccgagatgctcatgccggccttcaatgtattctaaaatgacgtgctctgcgatcagctgctgatttgtgatgacaaagacaaaatgcggctgaaagatctttttttctttatcctcttccaaatcccgctcccgcagcagctcgtaaatggacgataacaattgatcgcgggtctgttcattgtaaataaatcctttcgcatacatatgaggcagctgaaattgcggcagccacttcatccattcccattccttatattcgtcctcatgaaagataaagacaaatcgcaggtcatggtagctgttgaagaacgcgagctggccgatcagctggtgaatttcatttttgacgatctgaggtttcccgacaagccccatcggcccttcttgtaaatcaacggtcacgggcgcatggcggatatctttatacacacgctgcatgtgctgcgactgctccatcaagtcatccacatcacggttcgccaagtctccgccgctcattgaaatctcgtagcttgacgggaccgtgcccgttccgagccgaagcatcagaaaatccctgctttccagcgatttctcccaaatgcggccgctgatttcagaagttaaatatttcattttttcaaacgggggaaaatgatgcgtcagcacgtgcagctgtttttccgacagcgtctgaagctctttccgtttgctttctaaatactgcttgtacacacgctcccgtttttcctcccgttttttccgctggtttttttcacggaaatactgcacggtggacgtaatgagagtcatcataaacatcgccaaagagacaaggatgaatatgcccctcggctgtataatggcgacaacccccattacaatcagcatgaccacaggaggcagaatgacgagccacagcccccggttattctgttcgctttcctgcgagggaaagctgaatgaaacgcggtcttcgggaagatcgtagaccatgcgcggcgttcttcgatattgcgggtatttctttttcatttcggtgcttggttttaccgttttggttaaaccggcttgaagcttttcgtgatgaacgatttctaaaaggtcgtcctccgtcagcctcacacgcagaaaattccacagcagctcatctcccgtccggagcctttcgggagcttctgcaagctttccgttcacataaacttcctggccatcagagacgacagaccagcatcctcccgactttcgcagataaaaagcccctgtttgagcggaggacggctctttgtatatatccgcttcctctgtttctgatgagaaaacgatctcatccttcccgccgataaaatacacggaggattcttcctggtcaggggtgagcagaagccgcatcgtctcttcttcaatccggcagggcatttcatttcctattgtcaattcgccggcacagttatttcccaggaaaacatcataacgatctgtttctttccgataaagggttgcggcgctttgccgtaacggaagtgtgccgaccgtgattgtatctttcatatccggaccgatcgtaatcggctgagagggcgggagttcagacagctgaaccttttgtacgttctctcggtaaaagacccataacagactcatatggcgaacctcctgacagcctgatcgttacatgcggccatttgatgtgtgctgttattttttttcatcttttttctcatctttcttgtcgttctctttgttatctttcgctttgtcttgtttgctttcatcttgtccgtcggaagcttcggcggtgtcactgttttcctccgcttctttatgctgttcctccgcctcttttttcgccttcgcaagctcgctttccacggcgtccagttctttctgcttttcgtcgtctttcatactgtcatccgctaataattgctgtttatattttgtaagtccgagccagatgtacgggttgtactcaagattgcggccgattttgatggcttcttcattttcccctctgccgatatcaatccaataaaggaagtgcttcgggtctgattgcagcgtgaccagattcccgatgtttttccgctgttcttccctcagattttcaactgccacataagaggaagcaagctcgtactgcacagattccgggaggctttccgcatcgtatttagcgagtgtgtcaatgactttgctgtactgctgatttaaaaaatagcggttgctttccgtaattgcctcttgcttcggctgggcgaaaaacagaacgtataaggagtaaagaagtgccggcacaaggaggacggcaagcgccagaccggcgtatctttggattttccatttctttttcggcagttttatgtatgtcttgtccctttcttcgagggaatcaattgcggtttgaatggcttcttccagttcttcaatcgtctccgcttctaacacgcttttcacctcaggagagaaatgaagcgtctccttgtacttcaaatattcatcgaaggtgtacgccccgtcagctgcaagcgccgcacaggctttgagctcttttaacaccctttctctatcttcctcataaggcggaaggctctcctttacgccgtaatgaagaaagtaaggcgtcagcgctttatcaaacacgatattttcaggggcggcaatcagattgagacgtttcagcttatgctgtttcacggcttggacgagacggtaggcaaattgccacctgctttttttatcttttccttttatatagcggaaagcctgataagaagaaggaggtttgattgtgatggttacttcgtcttctgaaactgagacctctttttgaaaaaaaggatcggcgtctttaatcacattcgcttccagcccgtcaagaagcttgattttttcccgctggaaggtgaacgtgaagcctgattcggtttcttcccggacggcgtctaattctgtttctaaataagatctgttatgacctgtcattccaccatgtcctttcataaaatttcaaggcggtctccgttcgtaatgccgcagtcagatagcttttgttctccggaaaaaaccgtttctttattgaccactctgatccaatagccttcacgcggcggaacggatacatgctgagcctgccgggcaatatcaatgacttttttcacagaatggtaatctgacaatctgagatcgaagacgctgccgttataatgtgttaaatctattgtaatatcgatatacatattcatatcacccttacatagaaagagcgccgtcttcttgattgaatcaggcgctccgtttcttcattcatcttattatccgcgaatttggttagcgatatcttggtcggtagactcaagcgtatttgccgtttgatcgagctgatgattcacatcttgaagcaattcagacattttaataaatgaaggtttcagctgctcatattgatccgcgaatgcttcacttgaagcaccttcccacatacctttcaaatcagaaatcatgcggttcaggcggtcaacctgattcatgacttcctgactttcaacgccatattgcttagccatcgctcttagctcttcgggtgtgacacgaattaatccagacatattccttataccctcctgtgtcatcagcctaaatatgggctaattcacttattttttgaacgtcattattataaaaacaaccaatcggcacagtcaaacaaatctgttttaattttacaaaatgagtcttatgatatatcggatttttcgtcatatttacacattttgtaaatacaatagtattatttccttattattttcgttttcactgaatgatcttattgtcctagtctatttccctgcaaagatgcctttcagtctgaaaagcaagatggtaagatcaagatatgaagctatgaaaaagtagggatacagatgaccaatccaaaggatccatttaagtacagtttcgacaggcttgaagatgttgccgaccatatcagtgaagttcttcaatgccccattacaatagaagacgttaatcataaactgcttgcatacagcacgcacagcgattgtacagatccggcccggacgtcgacgattatcgggcggagggtgccggaaaaagtcatcaacaaactgtggaaagacggaaccattccggcccttttaaaaacggaccagccgatcaaagtgaaagaaattgacgaggtgggcctaagcaaccgcgtggcgatttccatctggaaaaacagtcaggttctcggatttatttgggcgcttgagatcaaaaaaaagctcaatgacgaagatctgaagacacttcagctggccgctaaagcggtgcggaacaagcttttgcacctgcagatccgcaaaacgaaaatcgaagagcggggccaggagtttttttggaaaatgctgaccggccatatctatcaggaagccgagatggccgaagggtttcataagctcggaatggcgctgccgtccgtgttcagcgtcatgatcatccgtttacatgatgagctgactgaaaagacggaacaacagctgcaatatttgcaggaaacgacacagcagattcatgtcatgctggcgactgttgattcaaatgaattaatcttattagccgcgccgaaaaccgatcagccttttaaagatttaaagcacttcgctcttcatattcaaaaacagctgaaggaacgatataaaattgaggatgcgtcgattgcgatcggcggtatttacgaatcgatttcttacgtttaccgatcctatcaggaagcgctctccgtattaaaagcgaaagagcggtttgtgagagaaaccaaacaccttttcagcttttctgaactcggcatttatcagtaccttgatgtgttggatgaaaaacgcaagcacagcggctatatgaactattccctgtcaaagcttgagcagtatgacagggagcaccaagccgatatggtaaaaacgctcgaacattttattgatgccgacagcaacgtcaacaccgccgctaaagcgcttaacatccatgtcaatacattgaattacaggctgaaaagaatcagccagatcgcagaaatcgacttaaaaaatgtgaatgagaagtttacgatttacctggatatcaaacttcgcagcatgggttcgtgaaatttcacaaatccgtgtttttttattttctgtttcaaacaaagaattttcgcaaaaatcgcgctacacttgaagcatcacacaaacattgggggaaacagacatgattatcggggttccaaaagaaatcaaaaacaatgaaaatcgagtggcattaacacctggaggcgtttcacagcttatcggaaacggccatcgggttcttgtggaatccggagcgggactcggaagcggctttacaaatgaagattatgtatcagcaggggcggaaattctggaggacagaaagcaagtatgggatgcggaaatggtcatgaaggtaaaagaaccgctggctgaagagtatgcgtatttccgtcaaggtctggtcttgttcacttatcttcatttagccgcagagccggaattagctaaagcgcttacagaaaaaggcgtgacagctatcgcgtacgaaacggtaacggacggacgttcccttccgctgcttacgccgatgtccgaagtggccggcagaatggccgcgcagatcggagcacagtttcttgaaaaaccaaagggcggaaaaggaattttattagccggcgtaccgggtgtatcccgcggaaaagtcacgatcatcggagggggcggcgtcggaacaaatgccgcgaaaatggctgtcggactcggtgccgatgtgacaatgatcgatttgaacgcagaccgcctgcgtcagcttgatgatattttcgggcatcagattaaaacattgatgtcaaaccctgtaaatattgcagattccgtcgcggaagcggatcttctgatctgcgccgtgctcatcccgggagccaaagcgccgactctcgttacggaagaaatggttaaacaaatgaaaccgggttccgtcattgttgatgttgccatcgatcagggcggcattgtggaaaccgtcgatcatattacaacccacgataatccgacttacgaaaaacacggcgtcgttcactacgctgtcgccaatatgccgggcgccgtaccgcgtacgtctacgctcgcattaacgaatgtaaccgttccttacgcgcttcaaatcgccaataaaggcgcggcacaagccattgcagacagccctgcgcttaaagcgggcttaaatacggctaacggacatgtcacgtatgaagcggtagccagagacttaggctatgactacgtgcctgctgaaaaagcaatgcaaggttcggctgcaaaagcttaatagagatgaagaggacagcctgatcagcgggctgtctttttcctttctcataaaaggaaaaacggccccctgtctcgaatatcaattcatatcccggaagaaaaaggaggattcatatggctgttcagcactatggtgtattaaaaggcactgtgttagatatgagaagggaaacagatgatgattctccgcattttcaagtcgaggtgctaggcgagcctgatacgcgctatcgctgtgcgatcaatgtcatgtcaagttcaaaagaatcagaggttctgtatgcggcacgcgatcattttgacgcaagcgcgatcaccctgctgccgaacattccgtatggatataccccaattgatgaaaccagccgtgagctggcgctggattatgtccgcggcggattgtttgatccccggaacatggtgccccttccgcatgaagtcaccgggccggataatgacttaaatgactttattgagacgtacatgcaaaaagccaaatcagaaaaagccaccgtctatatttacggctctaaattcgggccggagccgggcgctgataagattttcgggttcaagccgacaaacggcatgcataatattcatatgaatcagggaaacccaattgatacacgctggaagaaggataacggaacgtggcacgacggcggtattttaatccagtttgcagaccagtgggccgcggtctttttggcttttctgtctcagtcatggtgcacggatgaagaaggccacccttatacattttgtgatcatacacagcttaacggctgatgtccgcataaaaagcctgccgaaataacggcaggcttttcttattacattttagcagcttcggtccgcttcaggctttccggcctcatatcacgccagtttgtttcaatatattcgagacaaacggggcgggtttcattcgtcaggcgggtttcccagccgtccggcacatccagataggccggccacagtgagtactggccttcagcattgacgagcacatggtatgaaccgtcttcccgttcaaatggatttgtcatatcatctctttcctttctttaccggactgtacgccgtccgtttaatttctctgccagaatcgcgccgatgtcggcaagcgggcccggctggcacatatctttatggcggcagtctaggtcataccgctcgattttccccgtaatatacggtttccaagtatccggctcaatcgggtcaaaccactccggaataatcgtggatctgaagaacagcacatctccgtggaacggcttcggcttgtatgttcctaacagcccgacagaattaacgtacgtgtctttcagattcatcatcactgactcgtccaggctggctaatgcgctcccctcacggcggagaatggtcagcgcggtgtcaaaatcaagcggctgatccccgaggctgtccgggtcgtaccctcccagggcaagcagcgcaatgacggcttcctcgtcatcaggcgcattttttatcggcagaaaatgattcggatacgcgtcaagcatcaccaaaagcgaaacctcttcgccccggctctgtaattgtgtcgccatggcctgaatgacattccctccgagagaccagccgagcagacggtacggccctttcggctgcacggtgcggattttttcaatataatccgccgccatgtcatctaagctttgcggaagcggttctttttttccgatgcctctcgcctgtaagccgtatatcggataatcagcctctaaagaagacatcagcccggcataacaccagctgagaccgccggccggatggacacagaacaacggtgtttcttctcctgccgttctgagcggaagaagaacatcaagcgcgcttgtgcccgttcctgactcaagtctttcagcaaggcttgccaccgtaggagcttcaaatagtgttccgatactgagctcggctcccatcgcttcccgaatacggctcattaaatgaaccgcaagcaaagaatggccgcctaaatcaaaaaatctgtcatcaataccgacacgcggcagatgaagcacctctgcgaacagctcacacagcatttcttcctgcggcgttctcggtccccggccggtgacctcagtttggaagtcaggcgcagggagcgcttttcggtcaagctttccattcggtgtcagcggcagttcattcatttggacaaaagctgacggaatcatgtaatccggcaggctttcttcggcaaaccggcgcacgtcccccgtgtccaaagtgctgccggcagatcggacaaggtaggcggccagccgtttatctcccggccggtcttcacggacgactgcggcggcatcctcgacatccggatgtttgacgagaaccgcttcgatttctcccaattcaatccggaagccgcggattttaatctggtggtccgccctgcccatataatcaagagaaccgtccgtccgcagacgggctaaatcccccgtccggtacattctcgttcccggcgggccgtacggatcagccacaaagcgttcggcggtcagactttgccgccctaagtagcctcgcgccacgccccctccggcaacatacatttcacccgttatgcccggaggcacgggctccagccggtcatcaagcacatatacgttcagatcaggaatgccgcagccgatgaggctgtttgctctcagttcggcaatgtttttgtctaattcaaggtaactgacgtgcaccgtcgtttccgtaatgccgtacatgttcacaagcaccggctgattgtccgcgtggcggctgtaccaatcctcaagccggctcagctcaagcgcctcgccgccgaagatgatatatctgagtgcgagctgacgccccagctctttgtgttctttttccgcatgcatcagctggtaaaacgctgacggcgtttggttaagtacggtcactcgctctttcacgaggagatgtagaaacgcttccggcgatctgctgatgtcatgcggcacgacgacgagacgtccgccgtgaagcagcggcccccatatttcccagacagagaaatcgaaagcgtaggagtgaaacatcgtccatacatcatcagaattaaagtgataccaatgccgcgtcgactcaaacagccggataacattgctgtgcggaatgatgacacctttcggcacacctgttgatcccgacgtgtaaatgacataggccgggtgaagcggtgacagcggacgaatccggtcggcattctcagggttcgtgacggcatattgccgaagtgtttccttattctgcggatcatccaggatgaaggccggcatgccgttttcgccagagagcttacttgcgccttcacgattggtgagcataaatacaggcttggcatcatgtaacataaaagcgatgcggtccgcgggataatcaggatcaagcggcaaatacgctgcccccgtcttcaggacggctaacagcccgacaatcatatctaaagaacgcggcagcgccagtgcgacaaactgctccgggccgacgccgcgggcaatcatcatgtgcgcgagctgattggctcttttattcagctcttgataagtgagtccgctctcttcaaatactgccgccgtttcatccgattttgcggcggcctgtatttcaaacagttcaggcagtgtctgccgaggctgaatatgctgttttgcccgtttaaccgacaaaagcttccggcgctcttcatcagaaagaatggttaagcttccgatcggtttatccggatgtgatacggcatcttcgagcagaagaagcaggcgtcccgcaagtgcttcagccgtttcttttctgaataagtctgtactgaactccagaaagccttcaataccggcaggcgtgccgtcatcatggcgctgttcagccaattccaatgtcaaatcaaatttggacgatccgacactgctgatttgcaggcttgtttccatatcaggaagactgagtacagggtcaggcgtattttggaatgcgagcatcacttggaacagcggatgtcttgaccgggagcgaaccggattcaattcttccacgagacgttcaaacggcacgtcctgatgttcatatgctgcgagattcatttccctgaccctttcaagaagctcacaaaagctcggatcgccagaggtatcggttctcagtacgagtgtattaatgaacatacccacaaggtctcctaatgcgtcatcactgcggccggctatcggactgccgatcggaatatcggttcccgccccgagccgggtcagcagtgcggaaagccctgattgaagcaccataaacaggcttacgcgctgatttctggctagtgagagaagacgggcatgaagctcttggccgatgttgaccggaatgacgccgcccctgtagcttgattcagcgggacgcggaaaatcagacggcagctccagctgatccggtacattttcaagcgttttcttccagaaatccagctggcgcgcaattaagctctcagaatcagacgcgctgcctaaaagctgctgctgccaaagcgcataatccgcatattgaaccgccagcggcgcccattctgctttttcacctgtttgccgggcgatataggctatggataagtcacgcatgagcggattcaaggaccagccgtcgcctgcgatgtgatgcaggagaaccatcagcgtatattcgccgtcaccaagatcaaacagctcagcacggacggccggctctttagcaagatcaaaccggtatcgtgccgcagcggcaagcatgtcttggagctcgtttttgtctgcttgtgtcactgtaaacacagggcgggcttcttcagcaggtaaaatgagctgatgagatgatcccttattttccggaaaaacggtgcgcaggctttcatgacggcagacaacatcgtaaaaggcgtgtttcagcgctgattggtcaagcttgcctgacatgcggacaatcaccggaatgttgtaagtcgggcttggcccttcaagacagtagagaaaccaaagacgcagctgcgcaaatgacagcgggatgtgctccggccggtcaaacggcttgagcttaggccgcgcactctttgcggtgtcaagctgtgcggcgagcccggcaacggtcggcgtatcaaacagacggccgatgccaagctctgcgcccatcgtctcccggacccggctcatcaggcgtccggctaagagcgaatgtccgcccaattcaaagaacccgtcatcaattccgacccgcgcgagaccgagaacttcggcaaacagatcgcataatatttcttcctgcggcgtccgcggccctctgtcagacaggacagcggaaaaatcaggtgcaggcagagcgctgcgatcgagcttcttattcggcgtcagcggcaattctttcagctgtacaaacgcgcccggcaccatataatccggcaggctttcgcccatatattcacgaagtccgccgatatcaaggggctgatccgcgacagcataagccgccagccgcttatctcccggctggtcttcacggacaatgacggcggcctgcgaaatacccgggtatttcgacagcactgactcaatttctcctaattctatccggaacccgcggattttaatttggtgatcggctctgctgatataatcaagcgagccgtcctcacgccagcgcacgagatctcccgtccggtacatcctcgcgcccgcgggtccgtacggatcggcaatgaatctttcagctgttaaatcaggacggttataataacctctggcaagcccctcgcccgctatataaagctcgcccgcaattcccggcgggactggctgcaatgcggcgtccagcacgtatacccgcgtgttccaaatcggctttccgatcggaggcgcccctgtatggccttttgcaagcggctgtgcggccgaccagattgttgtttcagtcggcccgtacagatttgtcaccgtacagcctgattcaagcagagcatgcaaaagcgcgttcggaagcgcctcacctccgacaagcacctgcagcgcccggagggaatccggttcattggtgactaatgaatgccacaatgtcggcgttgcctgcatgattgaaataccgtatgagtgaatcatgtgcgcaagcgcccgcggttcctgaatcgtctctttacgtgcgatgacgcaccccgccccgctgatgagcggaaggaagagctcaagtccggaaatatcaaacgccgcagtcgtaacggcaagcaggcggtcttgtgcgccgagcgggaacatttccctcatggataagaggaaattgcttacgctttttaatgtcacgactacgcctttcggtttgcccgttgaacccgatgtatagatgatataagcggggtgcaaaggcgaacattccgcctgagcgggacagtcagcattttgagcggcaacggtttttaccgtatccgggtcatcgagaatgatcctttttacatcactgtcttccggcatgcggccggataagtccatcgttgtaatcaggcatgcaggctgtgcatctttgagcatgtatgtgatccgctcagaaggaaaatcaggatcaagcggcaggtatgcggctcccgttttcaaaacggccagcatgctcacggccaactcctgtgaccgcggaagcagcaaagcggcaaattgttccggtccaagccccttttcctttagcatgccggcaagctggttcgcgcgcttgttcaattcggcatagctgagctcttcgttttcggtgatgattgccggccggtccggtgtttttacggcctgttcgtaaaacagctccggcagacttttctgcttctcggccttgcgcgtgtcattccagctttccagtacgcagagacgttcactttcaagcagaaggttgagtgtgccgattttttgtgtctggtctttcacagcggattccaacagaagcaggaatcgtttttgatggttttcaatatcttcggcgctgtacacttccggattcgcatcaaagtccacacgcattccgcttccgtccgctctgtcgtaaacgttaattgacaaatcatcaacgggcccggctgataagttatggacggtgcctggcgctccggcgaaatcaagcgcgtagtcaaacggcatcacattgacttgcgggccgaacagcctgcggttttctccgagcaatttaagatcgcggcgcatgtcttcatggcggtatttctgatggcgccggatgtttcggatttcttttgccacttggctgacggcctcatgaaaattcatatccgggcggagagaaagccgcaaaggcagaagattcatgaccatactcggaatattcagtgaaatcgagccgatccgtcccatcatcggtaaaccgagcacgatatcccctgcgtttgtcatccggtggacatataccgccgctgcggctgtgacggcttcatgccagttcggaatcgcttttacatgctgtaaagccgtttcagaaagataagccgtgcttctccgaaagcttgttgacgttctcggcgctctttctgccaaactgacgacatcaggttcatccgcaaatttctccatccaaaactcccgatctttcaggaattgatcagacgcgcggtattcttgttcttcttttaccagttcctccaaagagccgaaggagcgcccgttatccggacgtccttcccgtattgcggtgtacatttgcgccgtacgccgtgccagcagtgaaaaaccgtagccgtctatcgcaatgtggtgaatgcgctgataccagaaaaagcgttccggtcccgcctgaaataaaatgtcgcggaacaaaggcccggccgccatatcaacgggctgagccaaatctgtctgcatgagtctgagtgcggcctgcttcggatcagcttctgaactcacatctatgacatcgatcgcagcctcaaatggaggattgatgatctgcttcggcccgtctgctccctcttcgaagcgggcgtgtaatgacgcggcttccgtcagcacgcgttcgagagcggttttaaatatgttcacatcgatcgcgccgtttatctcaacgtactcgcctgtattgtaaatcggattatcaggatcaagctgctgcgcaaaccagataccggcctgtgcgcctgtcagaggcagctgttgtgtatcatgcattctattctctccctttataaataatctgcgttcggcaagactttttgagatcgggaagaaagaagtctccaccactcttccagcgtcgggttctccgccagttccacaaacgtcacttcagctccgtcacggcgccattgttcgacaaggctcatgattctgacggagtcaaggcctctgtccagcaggtcttcatgatccggaatatcagacggtgattcttgaagaatcgccgcaatttgttcccgcacccggtcttttgtcaatacggcggaagtcttcccttctccttcagaaaccggcgcgccgcccagcagttccagcacttcgtttgtcaaagccgtgtaagcgcaacgctgagacgcatattcgatggccatcttatgtttttctgaagaaaaatcagcaacggcgtctccgataaagaagctttggatatcatccataaatgcttcacaggctgtgacgagacagccgatgtgtgcataaattcccgtaatcatgagctggtctctgccgctttcacgcatgatgtcaaggagattcgtccgtttaaacgcgctgtatctccactttgtgaggactatgtcctgatcatccggggcaagctccggaatgaccttttcttcataaggcccgcttttcagccccggcccccaaaaatccgtcagcagcgcgcggtccgccgggtcttggctgcccggctgcgcggtgtacaccaccggaatgccgagcgctttgcattgctcttttattttcttgatattctgagccgcctccgtgatcggagcctcacctttcgcaaaagcatcgacgaaataattctgcatgtcatgaatcagaagcaccgctcgtttcggattcagcgtccacgatactttattttcaggcatatctgacgctgtcggcagcgcatatgcgggaatagacggtatagccaatgtaaacacttcctttttttaagattgtttgatttcagccggctttactttttgggcgatcgtttcgcgaagatcctttttactgaccttgccgacgccggttttcgggaaagaagcgataaattcaatccggtcggggattttatatgccgccaatccgcgctcccgtaaaaacgctttcagctctcccggtttcggcgcttctcctttcggaatgacgaacacacaggaccgctctccgagaaaatcatccggcattgaaaccatggccgcatcatgaacggcagggtgcgcaagaaggtgattttccacctcctcagcggctattttttcaccgccccgattgatttgatctttcgcacgtccttcgacgatgatatagccgtccgccgtcagtttgacgatatcgccggtctgataaaatccgtcggctgtgaatgatctttcattatgttcaggcgctttataatatccgcgaatcgtgtaagggccgcgtgtaaacaaatgtcccgcttcaccgggggcgacatcccgcccgtcatcgtctaaaaccctgacctcatcaaaaggtgacatcggtctgccttgcgtattgacaatgatctcttcaggatcatccagtctcgtataattcaccaatccttccgccattccgaaaacctgctgaagggtgcatccgaaagcgctctttacgcggcgggccgcctcagcactgaatttggcgcctcccacctgcagcacttgaaggcttgataaatcatcacttcgcgaaccggatgcgtccatccacaccatcgcaagcggcgggacgagcgctgtaatcgtgacacgttctttttcaattaacgggaagcagtcatccggactcggcgtcggtgacagaacaacccggcctccggcatataaagttcccagcacacccggcgagctgagcggataattatgcgctgtcggcagcgcggccaaataaacgctgtgatgatccaagccgcatatttccgcgctgaggcgcaaactgtatatgtaatcgtcgtgtgttcgcggaatcagcttggacagccccgtactgcctcctgaaagctgtaaaaaagcgacttccgccgggcttacctcttccagctgaacaggctctctatgcaggctgctcagttcctgaaactcttcagcttcgccggccacaatgacatgcgccaaatccggaagtttgtctttcacctgtctggccagcgccctgtaatcaaaacctgaatgcgtatcaggaatgatgtatgctttcgcctctgcaaactcgcagaaatacgtaatctcactgcttctatgagaaggcagcgcgaaaacgggcagtgctccgaggcggaacagcgcgaaaatcacttcaaaaaactcagcgatattcggcagctgcacgacaacgcggtcttccttttgaattccgagcttatgcagccccgccgctaaacgatcggccctttcatctaattctttgtaggtccaatgtacatctttacacgtcacggcagtttgatttccgtataaagccgcacgctctttcagcattcctccgaacgtctcacccttccagcagccgtcttttcggtatttgtcagcccattcttccggccatggcgtaaatccagtcagcacgatccgttccctccttttttacaactcatcttggtaaagccccatcgcccggagcatggtgcggaatttcgccgatgtctcgtccaattcatcctgcggctttgatccggcgacaatcccggcacccgcaaagagccggagagaccttgtttccgcttcggcgcagcggagtgcgataatccattctccgtcgccttcagcatcacaccagcccgccattcccgtatagaaattgcggtcaaacggttcaatatcctgaatcgcttctctcgccgcatccgtcggcgttccgcataccgcgggcgtcggatgcagggcgatggccagctcaagtgatgtcgttgacggatcacgcagctctccctttacctcggtggacaggtgccacatcgcctcagttttaatgagtgacggtttttccggcacatcaagcacacggcagaacggttttagggcggcggccacggcggccacgactacggcatgttcatgcagatcttttgctgattgcagcagttcttccgctcttctctgatcctcggcgggatctgtgctgcgaggtctggaacctgccagcggattggacagaatcgatgttccgtttttggacagcagcagttcaggacttgcgccgaaaagcgtttttcttgtttctgacgttcccgtcacatcggcagcgaatgtatagccgcgcgggttgtgctgcgccaaatgcttgacggcctgaggaatgtcgatatccttttcagcggtcagatgaagcgtccttgacagcacgattttgctgagcggaccgtccgtaatgttgaatacgccttgttccacaccgctcataaagccctcaggctccggaacggggcagatgtcatatgtattggattgcggcttttctgcggaagattccgcaaacgaaagcgggcctgccgtatggacattcttcggtacaaaaagccgggaagcttttctgccgtcaaaaggaatggcgccggccgcaatcggatgtttgatgccggcttgctttgcctcaagaagcgtctgtcttacgcgttcaggcagtgagtccagctgattctccgcgtctgcatccggcacttttgcaaacacaccttctgcaaggagcgtacttttcggggaagctaaaaagaacgctccgggcttgtaagcgtccagcacctcttttgcagacacttccgtcaatacatgttgatttgtcatgattatccctccttctcgttacatcaaacgcctaaagtagcgccgccatccacgcataaatcatgcatcgtgatatggcttgcctgttcagaggccagaaacaaaacggcatttgcaatatcagaaggctttgccagcttttgaagcggaattcccgttttatatgtatcaagcgaacctctgataacgtcctgtgctccgttttcatcccgccacagcgcacgctgcatgtcggtttccgttgaacccggagatacgatgttgcagcggatatgatgggccgcaagctccagtccgaggcatttcgtaaacatggcggcagccgcttttgacgccgcataagccgccatggaagcacgcggaacgccggctgcattcgaaccgaccgtaacgatggcgcctttttgacgctcaatcatgtaccggcttacagcacgcgatacatgaaatacgccggtcgtattaacagaaaatgtttgatcccaatcttcatcactgagggattgcaccggacccggccgcagcacgcccgcaacgttcgccaatatttcaataggccccatgtcgcgttcaacggcggcgatgatatcattgacagccgcactgtcagatacatctgcggcaaacccctgcgcctgcacgcctttttgccggagtctgtcagtaagcccgggaagcaggtcttcatttgtatctatagctgccacatttacgccttgttcagcaagggcaagcgctgttgcttccccgatgccttgagcggcgccggtgacaacggctgttttccctttcattcccaatgcgttcatattatcattccctttctatattgataatgattatcattatcaattatgattcaagacaatcatatccaaatcaaaacacgcagtcaattagaaaattagaatcagccgcatttagttcgaagggcctgttttttctcatgcgggagaatacggggtatgcggccctcccggattcaggcagaaacgaagggctctgctgattaaaacgggcaggacagaaatatggccctctccttcaaactcgctgtattcagcgcggactccatcaccttcaaatccggataataaagcgtacagcgcctctgcgtgctgcgggattctgcttttatgtgttttttcaatttctcccgcagccagcaatacgctgacttgaagattttccgcagagagccggtctgacaaacgttctgcgttttcctgaataaaacgcttgttccaatgaattgacggacttcccgcaacataggtctggaacatgtccggcctcgtcaaaagcacttgcagcacaaaaagaccgcccagcgaatggccgaaaatcgtctgcctgcctctgtcgatcggataatcccgctccatcgcgggctttacttcttcttctataaactccagaaacgcttccgcccctccctgttcgggccatgccgcgccgcgcggatgcaccggcaattctgattcagaaagcggcatcgtaaaatcactgtgccgttcggcggaaaacggctgatctgtcgggtagccgattccgacaatcaccgccggaacaacgcctgttttttcaggccgccggctttgcacccgcaaagcttcggccattgtgccgaacacggaattcgcatcgagcaggtatatgacagggaagccggatgcaggcggttcttcctgaggtaaagagacaaagatacgatacgtacggcctccttttgagcgcatttctcttacttctgtgcccggaaccgcgtatcggccggccggcgcgaaaccccgctttatttgttttccgtccattatgtgttcaacccctttgtggcaattgctttatctaacctcattgataatgattttcaatatcaaaagacacctcaaataataggttttttgccaaacaaagtcaatggatttttgatataaaaaaagcaccttattttaataaggtacctaagaactatatagggataggggcttaatcccatgtaaagcgctcattcttccatggatctcccctcatatggtagccgtttttctcccaaaagccggggtggttttcctttgtgaactgaatgccgcgcagccattttgcgcttttccagaaataaagatgggggaaaacgcctcggagcggatagccgtgctctggcgttaacggctcgccgttatacgcatatgccagcagggatgtttcccgcgtaaaatcagaaagcggcaggttggccgtccagccctcttcagcgtgcagaatgacgaatcccgcttctttgtgcacacccgctttctcagcgatgtctttggcgcgtattccctgccagatattatcaagacgggaccagcccgtgacgcaatgaatatcatttttcacttcggcttccggaaaggctttgatatcttcaaagcttaacagcataggacggtcaacaagcccgtacacttgcagattccattttgacatatcttcataataaggaacatttccggcgtgaagcacgggaaacttcgttgtgacattttgatttggcggaatccgttccgactgttttgtttgtctcgttttcccgaaaaacatatggctccctccatttagtaaacctatattaaatctttgttgacaatcaatcacccttcgattacgctaatctggtacaagtgtaagggggaaaaacaaatgaaacaacgcaaccttcgtgcgggcgatatggcgcttatcggcatgtttgccgcactgatggccgtcggcgccaacattacatcaatggctccttttttgcaagttgcgggaattccgttatcgctgcagcctttcttttgtctgttagccgcgatgcttctcggcgccagacgggcagccattgcaatgacggtatacgcattggccggactcgcgggggcgcctgttttcgctcaattctcagcaggctttgcgccgtttatcggaaagagcggcggatttattctcgcttacatcccggcggcatttgcagccggatggctgctggaaaaaacaaaaaaacccggccgcctgcattatgcatgggcctctttgatcggtaccgccgtcatttatatcattggcacgacctatacgtatattgcgctgaaattatggcttcatgctccgatcagctacggaatggcctggttttacatgatatggtttttcataaaagatatcattttagcactgttattggcatctatcgcgcctgccgtatacagatctattcataaagcgacggggttcagcagaaatccggcgtaagatgttctcagcatacaaaaaggctcccctttccgggagccttttttacagaacaagcgcggcaatccacccgaatatcacaagcggaatgttatagaaaataaatgtcggtacgcacgtatcccaaatgtggtggtgctgtccgtcggcgctgaggcctgacgtcggcccgagcgtactgtcacttgcaggagaacccgcatcaccgaccgcggcggccgctccgattacggcgatcgtcgccatcgggctgaatccgagctgagcgcacagcgggacaaatatggtcgtaatgacgggtacggttgcaaatgatgatccgattcccatcgtgattaataaaccgaccaccagcatcaggagcgcgcctaatgattgactgtgaccgataaagcctgttgatgctttgaccaaggaagccacatcgcccgttttattcaatacatttgaaaaaccggccgcaacaagcatgacaaacccgataaaagccatcagaatcatgccgtccgtgatcagcttatccgcttcattgcgcttcatgactccgctgataaacagcgtaaacaaaccggcaagcgcgcccatgatcataccttccactccgagcacttgtgacagatagagctgaacggcaagcgacacggcaatggagatcagggcgatggcaatgctttttttcgtataaggagaagacgacagtccggcaatctccttcgtctcatatttcttcggtttccggaagacgatgacggataaaattaatccgactaccatcccggccgtcgggatgattaaagcatacggaatatcactgagcggcacctttaaaccggctgacgccatattatctctcagcatcccttggaaaatctgtccgaatccgacaggcagaacgatatacggcgcagtcagtccgaatgtcatcacacacgcgatcagtctgcggtctatttcaagttcgttaaatatttttaaaagcggcggaatcaatacaggaataaacgcaatgtgaacgggcaccacgttttgtgagaaacaggatatgattaaaataatcagtacgattaacacttttgacagtgcttttttccgcgaatcttccttttttccgattagtttgacagacgcttccaccattgcatcgggaagccccgtctttgtcagcgccgcggcaaatgctccgagcagcgcgtagctgaccgcgacggtggcatttccgccgagaccgtccgtaaaagccttcaccgtctctccgaggcctaagccgccggtcagcccgccggcaagcgcgccgatcattaaagctataataatattgacacgcagcaggcttaagacgagcataagcaatactgcgacaacaacagcattcattgatgagtccctccaaaaatcctttagtttgctaatgtagtagataattaaagttaacatacattctgcgctttagtcaactaaagattttggaaatcaaaaaacccgctgcatcaaggcagcgggatgctgttatctttcgggcgtaaaccgctcagtcaaaacagccaacgtccttgccatgacgcctgttgcgccggcagggccgaagcatgtcgctttattcgccgtcgcggttcccgcaatatcgagatgaacccacggcgtgttttccgcgaattcaccaaggaatgcccccgccataatcgcgtggccttctcttcccggggaattgttcaaatcagccatctgactgtttctcacccgttttttatccttttctgtaatcggaagctgccagatcggctcgccggattctttcgccgattccgccacttgttcataaaacgcggcgtgattggtcatggcgcccgtcatttcgttccctaaggcgacaatgacaccgcccgttaacgttgcgacgtctacaaggacagaggctccgtgctgcttggcgtatgtgatgccgtcggcaagcacgagacgcccttccgcatcggtgttcaggatctcaatggtttttccgctgagcgaaacgatgacgtcatccggcttcatggcatcggacgaaatcatgttgtcggtagacggtatgacggcgagcacgttttgttcaggccggagttcgccgataatttccattgcgcccaataccgaggcggcccctcccatatcgcttttcatgccgacgatgccggttttcggcttaattgaatatccgcccgtatcaaaggtaattcctttaccgaccaggccgatgacgtcttcccactgatctttgccctgatacttcagaacgatcattttcggcggttcggatgagcctttgttaacagcaagcagcccgcccatgccgagctcttccatttcatctttttctaaaatttcacactcgaaatcgtattttgccgcaagctcagcggcatatgacgccaaatcagtggccgtcagcatattacccggcatattcacaagcgtgcgggctgaattcgccccttggccgtatgccgcgccgacgttcaggccggcctgcacttccctcaggtcttcttcggtcacggcgcagactgatttcagttcctgatccggctcattcgatttatgtttataatcctgcacttcgtaaaccgcaagcagacagctttccgaaagcgcatgagcggcatcggcggcaggcacttccccggagacgaatgtatcgagcaacacggaaacttcctgttttttatcttgatgaatctgctgaaatactcgtgcaaagcattctttcgtatcttcaaacgaataatccgcttctcttcccaggccgataaaataaatacgtttcataccggtcgcagccggagggtatacttttgatacacgattgcgtttggcggacacatcaccatcctttaacagctgggtcagatgaccgtccaatttatcatccaattccttcgtaaatccgttcagcgtgcttttttgaaaaagaccgatgaccagtgtttcgggatgccgcagttgatcagatgcataaaacatgagtacacactccttatgtgggtatttgttatgtaaagtggtataatgaaaaaacatttttcattgattttattttaccaaactaagggcgttttctgcagtttttcgatacgatcggaatcagcagatacagaaaggatgtcgcatatggatgtacttatgaattttcctttactggcgagttttgccgccattatttttgcccaagttgtaaaagtgcctattcaatttatcgtatccaaaaaacttgactggtctcttgtgacgagcaccggcggcatgccgagctcccattccgctgccgtcaccgcgctgtcaaccggaatcgctttggaacagggactggactcgcccctgtttgcagtcgccgcgattttcgccgtcattacgatgttcgatgctacaggtgtcaggcggcatgcgggtgaacaggcgacagtcattaataaactggtcatcgactttaatcggtttgtcagcgaagcgaaggactttcagaaagcggaagagaaagaaaaacagaagaaattgaaagagctgctcggccatcagccgattgaagtgttcttcggcggcgtcaccggtattgtgctgacattgattttagattatttctttatgtaaaaacgcttcagcggatgctgaagcgtttttattcttttaccgttttgtattgatttctgaacacttgcagcgactttgtttcgttcagctttacaagttcgtcctcggtcactgtgccgttcccttttttaataatgtagacctcaagtgtttttttgccccaattgttatagacgtccttgacggtgtcaaagtagaggtcaaggcggctgcctttaatttttgagccggtatcggcgacaaccccgtaaccgtaattcggtataaaaagaatcgtcccgatcgggaaaacagacggatcggccgcaacagttgaatataaatcgcgtttgaccttcacgcctgaatatgtaattccgtactgcggatgacccggagattttccggtagattccgctccggcggtataaccggtggccgtcaccttttgtgacggatagcgttcccagtcaaaagcttcttccagcggctttaccctgcctgatgccttcttttccggctgattctgtaaggattgaaacggagtgccgatgtttttcaaaacggcgccgcgatgttccgtcatccaatttgtcagatcctttgcttcaacaccggttatggaaaagtatgtcgcatggcatgcgcccaaaaagagcacgatcatgaatacgcgtctgattatcgtcaatctgaaatcactctcctccgagtcattgttcccaactcggtgaggtgctatacaaaaagcgccgcgacacaaaaaaagctttcttgaataagaaagcggcttaaaacatttgatatcctctttttctgagcgcctttatggcaatgcctgacatgatggctcccgccagtccgcccgccaaaatcacgacatccgcaaccgctaatgacatgatgcgctgaaacaggctttgaaaggattcccccggcgcctgcacgtaactgatcatctttttattgctgataatgaaaaggcatacaatcggatagacaacagccataatccacgacattctaagcagcatgttcaacagaaagcctatgccgaaaaacagtacaaaaaatagtacgattgagatcaggacaaccggcaaactaatcacaaacatccaccccctacagcactttcagtgtacctcgggggcggtaaaaaagtcaacgtctggaaaaatcagcgtctctctttgccgcttccctggcaggagggacatgtttcggagccgccaagaagcaattgaaaataccctttacctgagcagaacggacacgccgccgtgctttttgctgtcgttttcatgcggatcacctttttttcttaattttctgataatatatcatatttacttgtcaagcaacaagtcagaatatgtaacataacaactcatgtaagcggaaacattcatttttttcttttacatgctttttatagcgctcttttttaaaagaagagaaaacccgcggctgcgggttttcagaagaatttaaacttcccttttttcagcgtcaggcccagcccgccgatcataaagagcgagcggttatcaatgacctttttcataaaggacgccggcgtgcctttaagcttcctgccgtatacgactccgacagcgttatgctcaccgagggaggcgaccgttcctttaatgtcaggcttgaactcttcaagctggcctcctttaatcagacggcccaggtttttggccacggtttctccttgctgcatcgcgatctgagcagtcggcgggtacggccgttccgtctcttcattaataaagagcgagctgtcgccgagaataaaaacgttatcatggccgggcgcccgaagatcgggattgactttgacgcggccgcgcatattttcaaaacccgcttcctccacgatcggatgtccgcgtacgcctgcggcccagacaacggtctgcgatttgatttcttcaggctcttcatccttcttgccgactgtgacaccgtccgcgcggcattcttgaaccgccgtgccgattttaaactcaacacccttgctctcaaggtattgaacggcgtaatcgacaagctccgggtcaaatcccggcagaaccgtcggagcggcttcgacgcagacgatccggacgagactttcatctatatcataatttctgcataactccggcttgcggttcgcaagttcgccgagaaattcaattcccgtaaagcccgctccgccgacgacgatggttaagcggtcagggcgtttttcggcctccgtattgtatgtcgcaaattggagctcaatatgctctttcagctgacgtgacgtattaatattagcgatcggaaaggcgaactcttttaagcctttaatcccgaatgtttcagggacggcgccaagcccgatgacgagataatcataagggatgtccccttgtgaaagcgtcacctttttattttgcacatctatcgcttttacggtatcctgcacaaatttgacccgtgattcattgattacatcttttatttgatatctgcagcggtcatgatgcagcgttcctgcgctcgcttcatgcatccatgtcgtttcataatgataattgtgtttattgaccaaagtaatgtcggcgtcatttgccccgatatgcttcggaagccttgttactgtcattaatccaccataacctgcacctaaaaccacgattttgggtttattcaatgccatcacatccaccttcttttttttgctgttagacgcataatcaaatcaacatttgtattagcttcagcttattggcgggattttatgaaatgaaatataaaattttttagaaaaccgcacatgtctgcatatcaccatactatccggaagaatcggaaaacattcaggaaaaaacagattggaatttgtccccatcttagcggcggccgcaatttttttcaagaatgaagcggccgggcggttttcggcactcgtcatcctttcaaattctatgttataattaataacaattttcaattaggaggcaatttggtatgcaagaggattcaaaggtttatgatattacggtcatcggcggcggcccggtcggcctgtttaccgctttttacgggggaatgagacaggcgagcgtcaaaatcatcgagagcctgcctcagcttggcggccagctcagcgcgctgtaccctgaaaaatatatttatgatgtagccggattcccgaaaatccgcgcccaggaacttgtgaataacttaaaagagcaaatggcaaagttcgatcagaccatctgcttagagcaggccgtcgaatctgttgaaaaacaggcggacggtgtgtttaagcttgtcacgaattcagaaacgcattattcaaaaacggtcattatcaccgcgggaaacggcgcatttaagccgagaaagcttgagctggaatcagcggaacaatatgaaagcaaaaacctgcactacttcattgacgacctcaatcaattcgcaggcagacgcgttgccgttctgggcggcggcgattccgctgttgactgggcgctcatgcttgagccgattgctaaagaagtcagcatcatccaccgccgtgataaattccgcgcgcatgagcacagtgtcgaaaacctgcataattctaaagtcaacgtgctgacaccgtttgttcccgctgaacttgtcggtgaagaccggatcgaacagctcgttctcgaagaagtgaaaggcgaccgtaaagaaatcattgaaattgatgacctgatcgtaaactacggctttgtttcttctctcggcccgattaaaaactggggccttgacatcgagaaaaattccatcgtcgtcaaaagcacgatggaaacgaatattgaaggcttctttgccgccggagatatctgcacatatgaaggcaaagtcaagctgatcgccagcggtttcggcgaagctccgacagccgtgaacaacgcgaaggcttacatggacccgaaagcgcgcgtccagccactgcattctacaagcatgtttgaaaaataatataaaaaagagtctgtgtcataccggcacagactcttttttatttaaacatccaaatataattcatgacggttccgacaacgagcgcaatgacaagcgctgacacgacccaaatcgtgcctaaaataatccggtcctgaattttctgggctttcgggctgtgcccgggctgtttttgttccacaccggcccctcccttcttctgcaaatctatctatcgtaacaaatgtcttacaacaaccaatactactatgataaccaaactgcaaatggatgacaagctgaccgcatatgaggcagcatgaaatcatttgacattcctgacaaaacgaagtacattataaaaagacgaacattttaattttatttaattatattattcgcttttaggggtgttatatatggaaaatgtatttgattacgaagatattcagctgattcctgcaaaatgcattgttgaaagccgatctgaatgtgatacatcagttacgttgggcggacacacgtttaaacttccggtcgtaccggccaacatgcagacgattatagatgaaaacatcgcggcctggctcgcggaaaacgggtatttttatatcatgcaccgcttcgagccggaaaaacgcctggcttttgtccgggatatgaaagcgcgcggactgatttcttccatcagtgtcggcgtgaaggaaaatgactatgaattcatccaggagctgaaagaacaggagctggtgccggattatattaccattgatatcgcgcacggccattccaatgccgtgatcagcatgattcaatttattaaagaacatgtcccggaaagctttgtcatcgcagggaatgtcgggacgcctgaagccgtaagggagctggaacgcgcgggcgctgacgcgacaaaagtgggaatcggccccgggaaagtctgcatcacaaaaattaaaaccggcttcggaaccggcgggtggcaattagccgcgcttcgctggtgcgcaaaagcggcgagcaaaccgatcattgctgacggcggcatccgcacgcacggcgatatcgcgaaatccatccgattcggcgcgtctatggtcatgatcggatcattattcgccggccacgaagaatcaccgggacaaacgattgaaatcgacggaaagctgtacaaagaatatttcggctccgcttctgaatttcaaaaaggcgaaaagaaaaacgtcgagggcaaaaaaatgcatgtcgaacataaagggtctttgcaggacacgctggttgaaatggagcaggatctgcaatcttccatctcttacgcaggcggcaatacactcgaagccatccgtaatgtcgactatgtaatcgtaaaaaactctattttcaacggcgacagattttaacacgcagcagagccgatcgaagataaaaaaaatgacattcaatatgaatgtcatttttttcattaaataccgaaataaagagccgcactggctaacagattaatcacaaaaataaacaaaaagatgtaacgaatgaatttattttgcaccggagcaaatataaagagatatagtcctgcaaccccaaaagtaagaacaggaaacagccactcaaaggataaagaaatgatataaccgataatcataacaatcggcacaccgattaatgataatttacttctcatatgatttctgccccttttacttaaaaattggtgtgatgtaagcttcaataatggcagcggcgatcagcagacaaataataagcagcaccaatattccaatatgcctgaacattgaagccattatctttttttccttagaaaaacacagcctgatgaccaattcaacgcccttaaaaccaatggcgccacttaataataacgcgggaacttcaaatataccatgaggaattagcagtaaaaaaatctgataaaaaggaaccccgctatgcagattttctataatagagccgcttaaaataaacccattagtgaataaataaaagatagaggtcaacccaaaggtaagaaaacccgcggctaaaaacagacaagcgattgcattatttttcagcagttcaaccgcgcctgacgagccgttgtaagccgctgatgaaacaaagtgatcgaaaaaaaacgcagcgaccacaccgcctgaaaaaaacagcactgacgcgattaacggaatggcggacgttctgattgccggcaacatgcggttcatcatgtatagatacgctcagccaattcttcaatctcttctaatgaatgctcagatgactgatactccgccgcaaaaacgccttcatgtataataccgatcgtatcgcacagcgaatgcgccagctccagcaggtgagtcgataacaggactgtatttccctgcttgacgtactcctttaataacgtccgtatcgttttaccgctgattaaatcaatgcccgtcagcggctcatcaagaattaatatctttggctgatgaatgagcgctgccgcaattgataatttttgtttcattccatgtgaataagttttaatcagctgatttccgtcttgagaaagcttcagcgtctccaacatattctttatataatcatttgtccgctgagacggaacttgaaacatctccgctgtaaagcgcaagtattcgactcccgttaaataatcatacaaaaaggcatggtcgggcacaaaaccgatatcagccgatatttgccccccctcttctgaatccagttccttgccgtcaatcatgacgcgtcctgaagtcggtttaagcaggcccgaaatgattttcaaagtcgttgttttcccgactccattagtccccagcaaagcatagattgagccttttttcacctcaaacgaaatatctttcaatacctgtttttcactatagtttttttgtatattcactaatttaatcattgttcgcaaacctttccgccatattgattctgcgaagaaacagaaacatgactccatagtttaatagtgtgaacaggacaaaaatacctgatgcagaatgaataagcatcgtttcaagttccggctttttatagataaaataggacgtgatcgcagcgatttgaagcgacacaatgaaaatgaaagaactgtataagttgttatacgtctttgctttccccgcttctccaatttcgtacagatgctcccagtttttcttaggatacagggcggtgcttgaaatctggacaagactgtataaaaaacccgaacataaaaacacaataaacaagtagatcgtcagcgccgcggaagacggaaaaaacaccgtaatcaaaatggtgatgatgaacgaatagataagagcggcgagattataaatacatactttcggaaacaccagctgccacgcatgtttgatattccggtgaaacagatgctgattttttatttccccgtcaactgataatactgttttgagcgcatctccgacgagctgatacgaaaagttcgcaatgataaccgccgcagacacgatggcggctgccgaatacccgataaagtgatgcgatagaagcggaatacaaaaacctaaaaacagcatgaacaaatacagcatactgccgaagtttctgataaaaaacccgtcaattctcgataaaaacagcagatccttttgaaaaacggcatgaaatattttgttattcctatataatttcagctttggcgcaaaatcagcgtttgtcaaaaacatataaggaataaggtccattttcttcagcgtggccgaccacagtttaaacatccccgccgttaaaaggacggcggccgcaaacaccgcagcgaaaacgagcacggaatgtgagcggaatgctaaccatacatacggcgtattcatgaggatgttccggaaagccggtgactccgtaaagcttgaaatatcctttgcggtatactccccaaacacgagaagataaacggcatacccgactgcaagcggaaccagcaggctgacgctgaataaaatgcctttcaggattttcaagtaaaacaatttgctccatatatttgtaagaagataaacaacataagaaaacagcatagataaaaataaattgagaagaaaataaacgaagcccaagaaaaatacgatgatcgccgcagacccggtcatgcctgcgcttgataaaaacaaaaagaccggaaaaacaaaaagataccatacgaaaatggtttttttgatcgcctggccggcaaaaacagaaaacagctgtaaaaaacgcaccttttttaattgatgaatgaccttgcgcgtatccagcagaaaggcattgtgatgttctttaaagaagccggcagcccaaaaaagctgctcaagtgaaacggcgattaaaacaaattgcccccatgcgctgaggggcagctgaatcagttttgtcccgaatacaacaccgcatcccaggaaaacgagatataaacataacagagaaataataatggcagacagcagtttgctgttgagttgaggaatgccccaatcttcctttctttttcgaaacgatgacagggtattatatttgataagagccgcaatttgtttgactatcatactttcaatccttacatatgtatttgggagagaggctctttttgcagcttgtacaaaaagagcaattatttattggtcgattttaccaagcagctgcgtattttttgccgtatttcttaatcattgtttttgctgttgcaacgattgcataagaaattgcgcctgcgcctgtaacgataccgatgagagaaatgatagaagcaattgttgatgccgcatcaataatatcaattgcttttttagctgctgctgtagagatgcccagagtcgaagctaattcagcattggctgagaatgcatgagccgccgccacgtttaattcagttcccgttaataatagtgcataaaccaatgttgctgcagcaagagccgcgccaaacaaaatgaaagactttttattagattttactaagttcatcataacatctccctactctgttttttaatttataataaaattcagcttaattgactctctcccgagctaaattttatccgccataaaataattaaagaaaatagtaaagagttttaataaaataaaacatccagtcaaaatgattctcttgcctttactgagatcggtcagttttcctgcggcagcataaagagccgcaattgatatgagcagaaatggatccagcagctgcagactcaagctggtgccgccggcagaatatataagcgaggaatcagccgttaagtagttaacaactgaaagaatcaacattttaaatgccgagattaaagaagtcagtgtatatagaagcaaatatatttttttcggtttttttgtaccgagaataaaagcggcaacgaataatagaaatccgcctatcagaatttccacaaaagttgtgaagatcataaacccttggagaaacatgacaatcgtacgaacacttttctccccgatatcgtaggtactttctccgacagaagaataatacgactgcagaactttatcggaaatactgaattggaagagtaatgaacagatcaaaatgatgaaaaaagaacttaaaaatatttttttattgctcaattgacctatcatattatcatccttttcttacaaaataaattaactattctatacttttacaatttagtttattcctatcaaaaaatcaatatcctttcgaaaaatatgactttagaacgtgttgactaagagcacatctttcagattttttagttctatataccctttatttttttccgaatttgcaaatagtatgatttgaaccgttgatttgaggatttttgtgaaggccgtcactcctaaacctattgaaaatctgcccatttcctttttgtgacatatgtctgaattcatcacattttttttattgacttaaaacatggtttaagtcgtatcatcacccagtgacaaggaaaaaatactgttggaggtctttcgaagacatgttgttcaattcgtgaagcagcagcaaagtgtaatatgacagaatcaacgttacgttattatgaaaaaaagggactgcctgccgctgattgaatgtgatgaagccagccggcggttattttcagaagatcaaatgccgctccttgaaatcgtgatttgtttaaaaaatacccacatgaccatcaaaggctttaagcaatatattgattgggtaattgaaggagagagtcctattaaactccggcttgacatgatgaggagacacaagcggtcagtactggatgaaatgtcgtcaatgacaaaggcttatatcaaaagctctgttcaagagacgtaagttttttgaagtaaaaacaatcggaaaagaggagttaatatgaaactgacgggaaatacaatactgattacaggcggaaatgccggaataggattggctttcgcagaacggtttttaaaagcgggaaataaagtcatcgtgaccggacggcgtgagcacgctcttcaaaaagcaaaggaaatattcccggatcttattacctatgtcagtgatttgagcattccatctgaacgtatatcactgtttgattgggtgaaagaaaattatccggaagtgaatgtgttagtaaacaacgcggggattcaacaacgttttcatgtgctgaaagcggatgcgaaggacaattgggactattttaataaagaaatcacaacgaacattgaagctcccttccacctgtctatgctgttcgctccgttttttgccggaaaagaagatgcggctgtcattaacgtctcttcgggattggcttttacaccgcttgctattgcaccgatctattcagcaacgaaagcggcgcttcattcatttacaatgagtctgagacatcagctttctgattcatctgtagaagtgattgaagttgcgcctccggcggtgaatacagatttaggcggagcagggctgcatactcaaggagaaccgctggatgaattcgctgaggggatttttaaaggactgaaagagggcaaactagaaatcggctatggttcttcagcagaacggctgcgcatgtcccgggataaagccgatgaacatacggcaaatatgtacaatgcgatgaaacatacaattgaataacatctttgaaaaagcaaaacccgctgctgttgagcgggttttggcttttattaaacagataaacgcctttcttaacaatggtgcaagcgccatcgaaaagaaagacgtcctattttttcatcctgagaatggcgggctgatccttagcactcttccggcgtaccggcgtttttggccgtgcggaaagaagatccgcagccgcaggaagcgatggcatttacttcagttacgataaatgatctacctgcactcgggctgctttttatttcgcggtttgttcctgaataacgttttttattaatcgtagatcactcgctgaatcatacgctctactattcgcttcatctaagattcggataataattgctagcccgaaaaggatggcgccggatactacaccggccaagacgctaaagaatacggaaaactgcatactgttcgctaatgctttgtccgttttatattgcgcttgcgcgacagaattatcgtatagctcctcgcttaccttcttactcgtttttgcatcttctgctacgtccctatcatatattacgaaacccgcaataatccccactattacacaaataacgctcaaatacatgagcactttaacagtaatcttctccaaaattccacacctcccctatttatagtaaaattataccagaaacctaccattttccacaacacctgttcgttatgtaacacggacacctacgtattcatgcgcaagtgcccgtaaagctcttcgttatcatgtttacattacatataccatttgcaacattcttatatttcttctatgtatcaaccacactgcgttaattagatgtaatttacaatcttagaaaacgtgcgatttttttattaatcacttcacgcagttctcccgaccttttttcgctcaaaataatttctattgcttcactgagtaacaactttctcttgaaaacgcccgcaactctcccccgtttttggtttatacccataataaaaacgcctttcttaacaatggtgcaagcgccatcgaaaagaaagacgtcctattttttcatcctgagaatggcgggctgacccttagcactcttccggcgtgccggcgtttttggccgtgcggaaagaagatccgcagccgcaggaagcgatggcattcgggttgtcaatggtgaaaccgccgcccatcatggactgtttgaagtcaatgatcgtgccggtcataatatcaaggctttcgctgtcaaccaaaacggtgattccgtgctgttcaaacatgctgtctttttcgcctttttcgtgctcaaatcccattccgtaagacaggccgctgcagccgccgccttttacgcccacacggagaaacgcgttttcttcttcatgctctttcatcatatcttttatatgcaaagccgctgcttcagtaatagttactggaacactcataggtagacctccttttttaaaaacggatgctgatatctattataaaccttgaggagcgtatttctcaaacgagctgtttacaaataatagacgccgctgcatacggtttcggcgggtcccgtcatcagcacgtgcccgttgtcccgccaattaatcacaagatcgccccccgctaaatgaacggtgatatcccggtttcgttcggaaacaccgttcaatacggatgcgacagccgccgcacaggcgcccgttccgcaagcctgtgtaatgccggagccgcgttcccatacgcggaaatgaagttcatcggcgctgacggtttccacaaattcgacattgacgccttccggaaatctcgggtctttttcaatgacgggaccgagcgttgtaagaggcgcttgattgatatccgcaaccggaaaaacaatatgggggtttcccattgatacggctgttccggaaagctccgtttctccaaaaacaaaggtttcatcgatcgtccgttcatcttcattgccgagcatcggcagctcttttttggtgaggcgcggttcgcccatatcgacggcgacttcacgcacaatcccgttgtcttccgtaatgtctgctttcacaagacctgaaagcgtctcaatgtaaaaggacgtttcttctgtcagcttatgttcgtatgcgtactttgccacacagcgaaggccgttgccgcaatttttcccttctgagccgtcattattaaaaatccgcattttgaccggcgctttttcagacggacagatgaggatcattccgtcagagccgatgcccgtgtgaatgctggacactttaacggcaatctcagccagccgttcttccggcagctgttcttcaaattgatttacatatatataactgtttccaagaccgtgcatcttggtaaaacggaatgaattcatatcggcctccaactttttttcttttacttagtataaaagctcttctgctcggacacaatacaaatatcccccgtttttcatacataaaagctccctgcatatgcagggagcttttatcgtttactaaataaacatgccggcaatcgccgcactgagaaggtttgcgagtgttcccgcaataaccgctcttaatccgaggcgcgcaatgtccgaacggcggcttggggccaaaccgcccagtgtgccgagcataatcgcaatcgaagagaagttggcaaatccgcacagcgcaaagctgataatcgtagacgtttttttagaaaagtccgcaatatgcggaccgaagtttgaataagcgacaaactcattcagcacaagtttctgtccgatatagcttcccgctccgagcgcctcatgccaaggaacgccgattacaaatgcgatcggtgaaaacacgtaaccgagaatggattctaatgtaatatgtttgaaaccgaaccagccgccgattccgccgagaattccgttcactacggcgatgagcgcgacaaacgcaagaagcatggcgccgacattcagagcaatctgaaggcccgtggacgcgccttttgccgctgcatcaatcacattagcggcgccttcgccttcttcgtccatattaaaatcgccttttatcgtctgcgttttttctgtttcaggtattaacatttttccgaacacgagaccggcgggagccgccataaagctggccgccagcaagtattcgatcggaatgcctaacagggcgtaaccgaaaagcgtcgaacccgctacagccgaaaggccgctcgtcataatcgtaaacagctcggaacgggtcaatcccgcaatcagcggtttaatggcaagcggtgattcagactgtccgacaaaaatattcgcagccgccgcaagcgattccgttctgcttgtcccaagaagttttgacagtccgcctccgataacgcgaaagatgagctgcatgattttcaagtgatacaaaacggcaatcagcgctgagaaaaagataatgaccggcagaacgctcagcgcgaaagccgggctgctgcccacttttaacagcgggccaaaaataaagctgatgccttcgttcgcataatcaatgagaagctgcacacggcttgagaaccataaaaatacggcccggccggcgtcccactttaatacgatgaatccgaaggccatttgtaaacataaaccgacaatgacggttcgcaggttaattttgcttttcttctctgataacaaaaaagcaatggctaatatagcaactgccccgagcagcccccaaacgatattcaatgaatccacctctaaaattttatttaaaaaaagtctttattaagataacaatatttatttttgctgtctacaaattttttattttgccaaaacccggggcgcaataaaaaagagaccccgttcggagcctctgattaaaacatcggattttcttctatgaatgtatatatgttgtcaaccaattcagcaggcgtgccccccgtgaccacttcgccgttaaccaaggcgaacagggactccatgcattttccgcagtagcttaaacagccgtactcaagcacgtccaagttcggatccttctctaagatctcaagtgcttcctgggaaccgcgcgctaaattgctgacacagaattcaatcatcggattcatgcggtttcacctcacatatgtaccttatcctaacggaatttcctctattcgtcaaagatccagtttcacgctcaatgttatcgtaacatattaattcaggttaaaggttttactattacgtgttttctggtcaatttgtaggttattttaaaactattattgtggttttagatcaaattcgatataattctagatgttattttacatagttcgttattttgtaacaacattgactaccatatttttcgggcaaaaggggaatcattatgaaaaaattggtcttgatcggcgggggttacggaaacatgagggtgctgcaccgcttactgccgaaccagcttccgtcagatatatccatcacgctgattgacagaaacccgtatcactgcttaaaaacagaatattatgcgctcgcagccggcacgatttctgatcatcatatcagggtgtcttttcctgagcatccgaatctggatgttcaatacggtgaggtggcttccgtcgacacgaaaaacaaacaggttctgtttcatgaccgcgaaccgatttcttacgatgacgcggtgatcggactgggctgcgaggataagtatcataacgtgcccggcgcgccggaacatacttacagcattcagaccattgatcagtcacgcgaagcctatcaaaagctgaacaacctcggcgccaatgcatctgtcgctatcgtcggagcgggattaagcggcgtggagcttgccagtgaattaagagagagccgtgacgacctgaagattatgttatttgaccggggcgacctgattttatcaagctttccgaaaagactcagcaagtacgttcagaaatggtttgaagaacacggcgtcaccattatcaataatgcgaatattacaaaagtggaagacggcatcgtttataatcatgatgaaggaataccggccgatgccatcgtgtggacggcgggaattcagccgaataaagccgtcagagaactggacgctgaaaaagacccgcaaggccgcatcgttttaacaccgcatcacaaccttccgggcgatgagcatgtttacgtcgtcggtgattgcgcgagcctgccgcatgcgccgagcgcccagctggccgaagcacaggcggaacaaattgtgcagatcctcctgaaacgctggaacaacgaagagctgccggaaacaatgccgcaatttaagctgaaaggcgttctcggttcactcggaaaaaaagcgggcttcggtcttgtcaacgaccgtccgctcatcgggcgtgtgccccgtttattaaaatcaggccttttatggatgtacaagcatcataacggctgataagaaaaaagccgctgattgcgatcagcggccatttttaagagcccgcaacatagccgcgcttttccatttcttcatatatatcttttaaatgcggattcccttcccccacaatgacatcctccaccaacacgagcggatagaaaaattcatcgttcttgatgcgctccgcaagctcttctgtctccttttgctgaggcggtgcgtcaatatcaatataccgcatgttaaaaggctgctctgggtatttccgtttcagcgccgcctccagccattcaaacgtatctttggcgctcggcatattcacgcagcttgcgcaaagcgtttcagcgccgtaaacactgagcgtaaccggctttgtcatgtatatcatcccctttacaccagtatacaaaggacggggcagcttttgtataaaaaacggtttttatgttcaagtttaaatatgctataatggagaaagcagctttgcaaaccaaacattagatttttaccgttactgtgaatataatggttttatgtatatgaaaggagcgaatctcatgactgaggttgaaatgaaagagcaagtacaggaagtattggataaattacgtccgtttctgcttcgtgacggcggtgactgtgagcttgttgatgtagacgaaggcattgtaaagcttcgcctccttggcgcatgcggcagctgcccaagttcaacgattacgctgaaagccggaattgaacgcgcccttcttgaagaagtaccgggtgtcgttgaagtagaacaagtattttaatcataaaaccaggctgcatgacagcctggtttttttatttttacaaatagtcatcaaaccatgaacaaatataacggatgcgtttcatccgctgttcgggatggccgcttctcgacagctcatgcgtagctttcggaaatcggatgaacgacgtcgttttgttcagtttcttcaacgcggtaaagagctgctccgcctgctctatcggacagcggtcatctcgctcaccgtgcaggatcaaaagcggcgtcgaaacgcgggatgcatattttacaggagaacgatcccaaagcttatccgcttcctcaaacaaatcatgtccgagctgccagtcggtaaaaaagaagccgatatcgctgacaccgtggaagctgaaccaatttgaaatagaacgctgcgtgacggcagctttaaaacggcctgtctgtccgacaatccaattcgtcataaaccctccgtagcttccgcccgtcacaccgagacggccgctgtctataaacggatacgcctgaacggcttcatccaccgcctgcatgacatcacggtaatctccgcctccgtaatcacccctgacacgattgacaaaatcctgtccgtagccgtggcttcctctcgggttgacatacacgacagcatatccttgtgcggccagtacttggaattcgtgaaaatacgtatggccgtacatcatgtgaggcccgccgtgtatgtatagaatgaggggatatgtttgatcctcttcaaaaacggcaggctttaaaaaccagccgtttaccgtcagcccgtcctttgtttcatattgcagcttttccggcacggatatgatacgctcctctataaaccgatcattgtaaaatgtcaattgcctctcttccccattttcaagtgaaatgctgtaaagctcggaaggctgtgcgggtttggcaatgacagcgatacagcttttctgatcaggatgaaaagcaaaaccgttcacgtactcttcttctaatcggatcggatatacgaggccgtcaatcgagatataataaataccggtgcttccctgctcgctcccgagaacgtaaaagccctgcccgtcgtttgtccataccggccggggcgtcactcctcctatgattgaatccgcaatcagcgcatcgctcaaatgaacatccagcatatcggtcaggcaggacagccgctcagttttcacgtcgtacagccacgctttctctaaagtcgcattgcgaaattcattctcatggcccagcatcgcgatataagaaccgtccggtgaaaacacgcaggaaccgaaagaaccgtggtgcggcgtaatctgcttcaggcttccgtccgccagattcatcagatagacatcgctcggctttccggcgtcacccggctcgcataaattggcggtaaacgcaagctgcctgccatccggtgaaaaggccgcgccataatgatccgcttcatgatccgtcagctgctgaatctcacccgtttcaagatgaatcagcacaagctgggcccagcttccgttcagcaggcctttcccgtcacgtttatatgttaatgattgaatctcaaccggctcatactcgtcatgcttctttttttctttctcctcggcgcgctccgctgatgtcagactgacggacacaagcacggatctgccgtcgggcgcccatatcggatctgatacgccccaaggaatatcggccgcctgttccgcctctccgccggcagcgtcgatgatgtacagctgagggatgccgtcctccctgtcagaaacaaaggcgaggcgccgtccgtcaggcgaccaccgcggacttgtatttttatcgtccccgaaagtccatgggtttgagatgccggattctgtgtcatataccataatggctgaggaataggaatcctgattgactgttgtccggacgtaagcggctcttctgccgtcaggggcatattgcgggtctgtcacggatacgagagacgcaatgtcctcctcggttatgagttttttcaaatcgtttctcctccttttcttttttatttcgcttccctaaataaaaatccttctccagaaaaagaaagcgtccttctctgatgggaagaacgcttttttatcattatacacttttcacctgttctaaaggattccgttcaattacgcttccttctgacgggacagtaagcgccgcaatctcacagtgagggaaatgctcagaaagctgctttctcagctcttctccctttcctttttcaatcaggacaagaatcgtcggtcccgctccgctcagcgccgttccgtaagcgcctttcatttcggccgcatgttccacctttgaaagctcaggaacaagcatggcgcggtacggctgatggaggatgtcttttctcatcattttcccggcgagcgcccagtcatttgacatgatcgcagcaacgagaaggttgctgacggcgcttgctttaacggcgcgtcggtacggcagctctttcgggagcacgtctcttgcgtccctggtcagaacttcgtaaaacggaatcactgccacaacgtcgatatccgcttcggcaacacgcacgatatgtgtttcatcttcttcgtgaaggccgatcacaagccctcctgcaagggaagcagcggcattatcagggtgtccctcttcaagactggctaagtgcagcttgtcgctttccgacagctgcaggtcgcataactcatccgcaagctcaatggcggcgacgatagcggccgcgctgcttccgagcccccgtgcaagggggatgtcactccaaactttgacatgggcgggcggcagctctttctgatagcggtcagccgtccgtttggcgacttggtagatgaggttgtccgttccttgagggatgcccgcgacagtttcggtttccgccgagaactgccattcatcgtttcggaaaacggaaagcttcaaatatctgctgagcgccatcccgatggaatcaaacccaggccctaagttggcggtgcttcccggaaccgtaatggaaaacagcatctccgcctcattcatacacgcgccgctccatttaagtattccagaatactgtcctcatttgtcggcagcgtgatcggttttatgtcagatacgtccacagccgtgttcggatctttcaggccgtttccggtcaagactgcgacaaccttgcttccttttggaatttcaccggatttcacctgttttaaaataccggcgatggatgcacaggagcccggctcggcaaatacgccttcttcacgggcaatcagctgataagcgtgaaggatttctccatctgtgacttcatcaatttttccggctgactcttccgctgcaagcacagctttgtcccagctggcagggttcccgatccggattgctgtcgcaacggtttcgggatttttaatgacctcgccgcgaacgatggccgcagaaccttccgcttcaaaaccgcgcatcttcggaagtccggtgccgtttttctcatgatattctttgaaccctttccagtaggccgtgatattcccggcatttcctaccgggatcgccagaatgtccggcgcttcgccgagctgttcgcatacttcaaaggccgctgttttttgcccttcaatccggtaagggtttactgaattcactaatgcaatcggtgatttttcacaaatcgaccggacgatggccagcgcgtcgtcaaagtttccgtcaatcgcgatgatttccgcaccgtacatgacggcttgcgcaagctttccgaaggcgattttcccgtccgggatgatgacgatgcatttcatgccggctctcgccgcgtatgccgcagccgccgcggatgtgttgcctgttgaggcgcacatgatggtatcattgccttcttctttcgctttggcgaccgccatgaccatgccgcggtctttaaaggatcccgtcggattaacgccctctgttttcacatgcagttcaattccgagcttttcagaaagcttcgggaggtgaatcagcggcgtgttgccttcatgcaatgtcagggccggcgtccgatccgtcaccggcagaaattctttatattgatggatgagtcctttccacattagctccaaccgttcccttctacacgatatgtgctttttacttcttgtacaacttcgaggtcatttaagttttgcagaatgtcactgaaatcttcttccgatgtatgatgcgtgacgatcacgatttccgcgagatcgtcatggcctttgatcggcagctgcagaattttttcaaagctgacgccgcgctctgagaaggctgatgtgatttttgaaaaagagccgacctggtctttgacatgaattcttaaaaactgctgggcgtagatatcagacggctgcttcagatttctttcaaactgcggggcgacaaagctgtttccgtttacgccgagacgcatgtttttcatgaccgcgaccagatcggaaacgactgatgtcgcagtcggcatgcttccggctccggggccgtaaaacatcgtttcgcctacggcttctccgtacacgtaaacggcattaaactcgttatgcaccgcagagagcggatgatgatccgggagcagtgtcggctgaacgctgacttcgattttattgtcatcacgctgggcgatgccgatcagcttcatcgtatagccgagccgtttgctgaagctgatgtcttcatccgtaatccgggaaattccttttactttgacatcgtccagatcgacgttcatagagaagccgagacgggctaaaatcgccatcttgcgtgcggcatcgagtccttctacatcggcggtcgggtccgcttccgcgaatccgagatcctgcgcttccttcagcacttcttcatacgggcttttttctttaatcattttcgttaagatgaagttcgtcgttccgttgacgattcccatcatttttgtgatccggtcagaggaaaggccttcttcgagcgtgcgtaaaatcgggattccgccggcgacactcgcttcataatacaagtcacagccattttcctttgcggcggctaaaagctctgacccgtatacggcgatcagatctttatttgcggtcacaacatgttttttcgctttcaaggcatcaagaagatattgcttcgtctgttcgacaccgccgatgacttcaataatcacgtcgacctcagggtcatcgatcacatcatagacttctgtcgtcagcacttctttcggcaggtctgcgtctcgttttttatcaatatctttaaccagcacttttttgatcgtcaccggacagccgacctggtgcataagcttatcctgatgatcttgtataattttgacgactccgcttcccacggttcccagtcctaacagtccaatacgaatcgcttccaaagagaaactccacctttcttccttttgtccactagaaaaggacaattgttaacccttcacagacatttaagttacaaatattatataagcccgcatttgttttgacaagcggctgaatattgtttctgcggctatgaaaacgcttaacacactgatatgacaagattccctattttctaaatatttttacgtcatattttcttacgaactgattccttttccgagccacgccacaggcgggacaaaaacctgcgccgctctgacattcagcatgtcgtgacatgtctgcaaaaactgttcatagcgggtgcagtctgcaagaatgtagtcaagctgctcttcgtaaaactgtttttcagaatcatgagaaatgtaatagctctccaccgtctcaaagaaatgaagcggaaacagcaggcggctgtaaaacaggcgcttggaaaaggaggataacggcgtaacttgctcatattcctgcaaaaacgaaaacccttcgttaagcaagtcgtcacgatgatacaaatatgtgctgcgcatatattccgcaatatcacgggcggcatggtcgaatacccaatcgcccggaatgcggatcaatgattcctccgaccaggtatcccgttccatccgctgatggcagattgtccccgagtcttctgcgccgggattgtcatccagctccgtatccactaaatattgaatcgcattttccgctaagcctgaataataaggaaatgcttcgatcattttcttttcgaacggttcgagcggagacatatgaattttctgcatccagaatgattccagctgatccacccgttttccccataagtccttccattggccgatcctgcccgcttctttcacttcgtacggaaaaccccgcccttttctgtgaaattcggcaagctcccctccgacagaaaacgaccggtttgcgacggggatcggcgcttttaagagcgcatacgttttgccttcgtcctcaaaggtcagttctccttccttcgtaaagataaacactgaaacgtatgggtcactttgttcttgtaaatactgactcatgtagtaaagctccgtcagctctgattgcgaaaatccggaaacgggaataataagaaagaaggaattaggcgtctggaagcattggtatttctgataaacggaaagctgtctgacgtggatgccgtacttttctttaatgatgcttttcatcataatcacctgcctgaaaaattagagctattcacatcgtagtcatacgccggcggaattatgaatacatattgtaatcctttgaatcaagtggagaaacatcgtacacatcggaagggtgttgtataaactagtaaaaaaagattgggtgaagcaaatgtcagaaaaggaacaactgaatcacgtggaagctgtcgccagaacgcgtttaaaagaacggggggttgagacggacgatattgccgagctggtgtatttccttcagaaaaaatatcatcctgatttgacgatggaagtatgcaggctcaatgtggaccgtgtcatcgcaaaacgcgaggtgcaaaacgccattttaacgggaatagaattagatgtgctcgccgaacaaaaaaagctgtctgaaccgcttcagaccattctggcgattgatgaaagcctgtatggggttgacgaggtgctcgccttctctatcgtgaatatatacggctcaatcggctttacgaattacggctacattgacaaagaaaaacccggcattctcgggcgtttaaatgataaatctacgggcgaatgccatacgtttcttgatgatatcgtcggcgcaatcgcagcagcggcttcaagccggcttgcccacagcgccagaaatacagaataaggacggccgtcatggccgtcccttttttatagatattcaatccattcggttaaagagtcaatcgcatatgtcggcttccggtcgtaatctgccatatgctcacgctttgtcactccggtatgaaccagcagcgtatccatgcccgcattgatgccggccataatatccgttgcatagttatcgccgaccatgagtgtttcggaaatatccgttccgagcacacgcatcgcctgttccataataatcgattcaggcttgccgataaagacaggctcaacgcccgttgacaccgtcaaaacggatgtgagcgaaccgttccctggtaaaagccctctttcagtcggaatggcgacgtcgccgtttgttgaaatgaaccgggcgccgtttctgatcgcaaggcatcccgttgccaacttttcatatgtaatgccgcggtcgattcccacaacgacaaagtccgcgttttcttctccgaagctcagcccgttttcttcaatggcctgacggatgccttcttcgccgatcacatacaccgacgcgtcttttttctgctgggcgatatgctgcgcagtcgccatgctcgtcgtgaagacctgctcttcagatgccggaatgtcaaagctcatcagcttgtccgccacctgcttcggcgtccgggaagaattgttcgtcacgaataaatacggaatgccgcgcgctttaagcgttctcacgaattcacacgcttcttcgattttttccgtcccgttgtacattgtgccgtccaaatctatcaaatatcctttataatccttcatactcaacactcctgtggattttctcactcgttgttatttaaatgcggaaacaggccctaattctgtttccaggtaggttcttacacgggccggaaaggctttcagcacatccctgtttgacgtgatcagcgtaaacagttcctgatgatcggcttgctgatattcctgaacaagccgctttctggaagagatcagctgcttgagcttattcgcttcatcctcagctaccaccttttcatccgtcagaatatccatgatgtcgtcataactccccggatcgcgcatgataaagccgtcaatcatatcatttccgacatcgagaatgcattcgatcataagatggctgatccgctcaagcgcccttttttcgatttcgctctgccatgcaggcgtgctgtcaaacagcgccagctgggtctcaaaaaaacggagtgtttgttcgatattatttctgtcaacaaaatacacgtgacagcatccccttctgcatcaattattttctgattcgttttaaaacaaaatacgcgcagccgaaattgcagtattcataaatgtattcgtccaatgtgctgattttcgtttcaaaggttgctttttgattctggtcatcaaagaagcctttgagccgcagctgactgtatccccagtctcccacaatgtaatcatatttatttaatatgtccgaatagcgggctttgaacgcttcttcattaaagccgtttttaaaatcgtgtacgagttcaaactcggcattttgaataagaatcatgtcttcacctcttttatcactctttactatcataattcattgacttctgtccatcaattgcaaaatgagacggttctgacggacggaaaaattttccccttttatatccagtgtagcggttctgacgatccttattcaagaatgactttttccctgcacagacggctccatcacaaaaaacccaaaacctgcggcgttttgggttttttcggcttatcttatgcttgggcctggcgttttttagacgcttcgttcacttgttcatccgcatggtaggaagaacggacaagcgggcctgcttcacagtggctgaagcctttttgcatcgcgatttctttcagttcggcaaattcgtccggatgataatatttttggacttttaaatgttttttcgacggctgcaggtattggccgatcgccatgatgtcgacattgttcgcaagcaggtcgtccatcacttcaataatttcttccttcgtttcgccgagaccgatcataatgcttgatttcgtcgggatgtcaggctgcatttctttcgcacggcgcaagaattccaaagaacggtcatatgttgcacgggcgcggactctcggtgtcaggcggcgcacggtttcaatgttgtggttcagaatatcaggacgggtatccattaatgttttcaggttgtcgtaatttccgcccatatcggatggcagcacttcaattgtcgtgaacgggctttttctgcggatcgcccggaccgtttccgcaaagacgcctgctccgccgtctttctgatcatcacgcgccacggccgtgatgacggcgtgttttaagttcatcagtgcaaccgaatcagctacgcgttccggttcctgcagatccagctcagtcggcagacccgttttgacagcgcagaagcggcatgctctcgtacagacggaaccgagaatcatgaacgtcgccgtacgtctgacagcccagcattcatggatgttcgggcattttgcttcttcacatacggtatgcagattattttcacgcattaattttttcagacccgtatagttttcattcgtgttcagctttattttgagccattccggctttctcagatgctcgtctttctttgccatttccccatcatctccattatccctttattcatgttcgtgtgcgaaaaatttctatttcacgatggatataaaacttgcagatttctattcaatagtcactttaacataggaaaaatttctcgacaagggaagagaattacttacattttctcggattgttgccgcaaactatttgtattaatcctgaaaggagatcatgttgtgaaagttctgttatctgctcttctccttttatcatttttctgtccggctgcaagcgggaaagaacaatcggctcctgtttacggcgaacggatgcagttgtaccgcaaagccgaagcagtcacgcagattccttggtatgtacttgcggcggttgatcaatatgaagaaaatgtccgctcgaaccgaaaggatctgccggaaaaagcgggaatcatcagcatttatattccggatcatttgtggagcgggcctgaaaatccaaatcctaaggacgaggcgcccctcagcattaaagtatttgacgggatcggcctggacggcgacggcgacggaaaagccgaggtcagcaatgatgaggatatcctttatacatttgcacagtatttagcgggattcggaacggatcttgaccatatccgcatcggcctctggaattattaccgacgtgatcagacggtcggcattatcaccgaattcatgacactgtttaaaacgttcggccgccttgatctcggagagcacgcttttccgcttcccgtgaagacggattacagctaccgcagcacatggggcgccgcacggggtttcggcgggcgccggattcacgaaggaacggatctgttcgctcattacggacttcccgtcagatcgacctgctacggtattgttgaaatgaagggctggaaccgtttcggcggctggagaatcggcatcagggatatcaataatacgtatcactacttcgctcacctgaacggctttgcaaaaggtgtgcataaaggccagatcgtcaaacccggagaggtgatcggctctgtcggcagttccggatacggaccgccgggcaccgcgggaaaattcccgccgcatcttcactacgggatgtataaagataacggcagatcggaatggtcttttgacccgtatccccatttaagggcatgggagcgaaaagaaatccgcaggaaaaagtaaacacacagccgccaggaaagattgcggctgtgtgtttttatttatctttcttctgtttttcactcggcagctggacagaaggcgtcacacctgatccgccgcttccgttataaaactgcggcacctctccttgaatcgctttaatggagaccggaatattatttgtgacgactgatgtcttactggcaaacggaataatgaccttcactttaatttccacaaaaatactgatatcgatcagggcattgttaatgccgtacggctttatttttgtttttacatcagttaacgcatcaccgatcaggttaaagcgcacggggattttcggccccagatttccgagaatgctgtttcccgtgacctgccctaaagggatgttaatcataatttcatcggccgttttcgcgcctttttccgtttcatgctgcttattgttagactccgcttccttcaaatgagcctgaagctgctttgtcactttcgccttcatactgttgaccatttgtgtattaaaatccatcgttgtgacttttccgttttcatccgttttcatatcgaccatatctttcacattgtcgctgtgagacatgtattcttcaatggattccgtaatgacctctgtcgccacccgtttggtttccatttctcctatgttcatcagcaccggtttgattgaggagttgatcatccagaggctgatgaccgtcgatatgataaaaaaagcaaacgacagaagaagcacatatcgaaaaggcaaaggccctctcttgcgaagagcgctccggtatctaggcaagaaaaatccccccttacatatcacaatgtatgcttgtaagggggacatagtattttatttttactcttaaaaagtcaagcttaccttcactcaaatgagatggaacggcgggcagctatttgacattacggctgccgcgcgagctcccaggcgagcagatctcttaaaaactccggcataaagtattgtttttcttttgaatcgcggatgtaagggaacagctttccgagtgtaaacatgtcgagaacggcaaccgagtatatccgctccggatccacctcttctccgttcactttcacattgaggagatgcgtcacaccgtcttcaagaatgccggcctctgcctccgctccggcatataccatcctgcccatcacttccccgcggaagccgaggcctttaatccgcagctgctccatttgttccgaggcggcctggctgattgtttcctggagttccctgcctgaaagacgaacggcgaccggattgatcggatgagggcagatgcggtgcaggtcaagctttgtgacaggccccttctgtaaaggccccaaaatgacgcctgaattcaccatgctgacttcacagccgcaccagcttttcagcgcttcggctaatagaagcggcagcggcgattcctcaaaccacttcacgccggcttcttcattcagattggcgacttgtacggagagcaggttttccgcttcccgttctttctctttcagaaaagccgccgtatcttcagattctccgtgccaatcagccattttctgtacagatgcctgtttgctgacaatggttcgtgattcactttctatcgtgagctcgacacagccgacatagttcccgtatttctccgcacatgcaagcaatacgccgtttatgtcctgtccgtcctcaagaaggtggtgcgtatgtgattcaagaatgacatcgatatcgggaaatttttccgctgcggcccggtcatcgatcaggcctaaatgagaaagcagaatgatgatgtccgctttgcccttgatatcgtcaagtgattcttgaatgcttttttccgcatccgtcactgtccagccgagtttctgatagacgggataatacggcaccgtgacgcctagtatgccggcggtcatcccgtttttcagcgttttgatcacatagggcttggcccattccggccgatgtccgtcctcgtcaaacaggttggacacaatgacgggaaacgcggcatgagtatataaatccgccagctcatcgtgaggcagcgtaatcccttcattattcccgacggcagccgcatcaatctcaagacggtttaacaagtcgacattcgctttgccgaaggtcgcttccgttatcatttggaatcggtccatatgatcgccgatgtcgaatacgagtgtttcctccccgtttttttcatgctcacttctcttctgctcaatataatgtacgattttcggccaattttcgaaatggctgtgcaaatcattcgtatgatataaacggagcttctctaacataccatctctcctaccttttagctgaatatcccttgataaatcaattcacagccgatcaaaatcaagacgacccgcatgaaaagcacgatcgttttcgtctgcacccgcttattgacccacgcgcccattttgccgccgaaccacgcgcccggaacgaggcacagcgcatacagccaattgacatggccctctgcgatatgtgacacggaacccgtcacggaggataagaaaatgatgagcattgacgtcgccacagccactttcggcgggaacaaaaataacagcatcatggccggaaccataagagagccgccgccgatgccgaaaagaccgcccaataaaccgacgaaaaaggcaatggcgataccggtaaaaatacggtacgaatatgtataaagctcacccgattcatcctcataagtccggatcatgcctttatgcgctttattgaccggttttgctttcgccttcagcattaatgtaatagaaatcaaaatcataaaaagtccgaaccagacggaaaacgtatgcgcattaaaaagtttagacaaatacgcgccgatgatgcttcccgggccggaaccgataaaaaagatcagtccgcttttgtagtcaacggttttatatttcatataggccagagttgatgacaggcccgtaaaaataatcaccaaaagggacgtgccgatggcagtctgtggtgttacgtcatggaaaaacggagtcatcgtgcttaaatagagcatcgccggcacgatgataattcctcccccaagcccgatcaggctgccgaccgttcccgcgataaatcccaatatgatcaaaataagataagacatgtgtcttgaaacctcttttctagctgaataggtcgagctgcttcggagcaagcccggtatatgagatatctaacatttcaagcatctcaagcccgttatcggcggcgtctccgcctgagttattgttgaagagcacatacacattgcgcgactgctttttcagctcctgaagattgtttttccaatctttgagctcctgtttgttatagcggtataaatatctgacctcacgccagttttgtccgccgtcaggtttaatccagccctgcttgttccgtccgtgaaaacggacaagcgttttttcttcatccgttgctttcaggacggttggaatgctgccctcgccgatctgcggctcgtcacatatgctgtgaatccagccttcctccttcataaaggaaagggtctgttcgtaaaatggcggggaaaaccaagaccggttgcggaattcaagcgcgcacgggatatcgcccatctgctgcctgcaccatcttaaatatgcgacgttttctttcttgcagtcaaaccacggcgggaattggaacagcaccatggcaagctttccatgctctatataaggcgataatgacagcttaaacgcctcaaacatttcttccttcgattcaaagggaatatcgccgcgctgatgacccgtcattccttgatatgccttaatgacaaattgaaaagattccggcgtctctttgacccatctttcgttattgcgggcgggctgtatcgcgtaaaagctcgcgtccagctcaacgatgggaaaatgggaggaatacgcctgcagtttttgcgggcccgctgttttaggcggatagatgctgtcatgatccccccaccccgtcagtccgatataaatcacaatccttcacctctcattctagtttatcacaggtgtttttctctttccgtttccatgttttttctgaatgcacttttcaggaaccggtactgatgttcattggtgtccgaaaatgcctcatctctggaagaaagaatgtgctgatagacgatcggctctgaaaactgactgttcgtgaaatcatatatctccccgtctattcgattataaaaatgccagcttgtgcccgtttttgttttgagaatgtcaccgccgtaaacatcttggatgactaaagccgtcacgccgcactggcctttggccgggcaatcttccgtccattttgtactggtcttgcgcgaccaggatgccgttaatatgttcaagatttgattatacaatgtgttttactcctttttataaaaagataccacgagacccgctctccaaacgacaaaaaaagccgattctcatcagagaatcggctcttttatttcagaaggcttcagaaatgttccgaaagccccgctctgcttacgaccatcttggtacacacagcgtcccttgctgtaggtcgcagcaattcggtatggaaaggtgcggccttcatacaagctttgcttatgtttggaaaacatcgtttcttttgtgacggtaaaaggttccggccggacaatggcaaaatcagcgtcaaatccttcttcaagccggcctttattcgttaaaccgaagcgcttggcaggtgcttcggccgtccatcgggccacatgttcaaacggaatcccatgatcgatcgctaattgaatcatgccgagaagcgtaaattggcctccgctgatcccgccccacgacaggaacatattatcctcgcgtttcaaagacggatgacagggagaatgatccgaagacaccatatcaatcaggccctcagccaaaaccccgatcaatccctctttatcagcctctgagcggagcggcggagcgcatttggcggccgccccttttttgaggaagtcttcaaagctgaataataagtagtgcggacacgtttcaacggtgacatccaatccgtcttttttcgcctgctgaatggagagcacggcccgtttcgtgctgatatgtacaaaatgaagcgcgcatcccgtcgctcttgcatattcaatcgcccgctgcacagcctcgcattcggcttcttccggacgggaggaagcgtaagcgcgggcatcaattttcccttggagcgcgtactcggcttcaaggaatcgggtgagggcgtcgctttctgcgtgcagggccaaaatcttgccgcacgccgcgatttccttcattccctttaaaagagtccgttcatcggctgattgaaattcatccgttcccgatttagacagaaacgctttaaacccgatcgctcccgcttctgccatcggccggatatgttcggtatacccgggcatcaaaccgccccaaagcgcaaaatcaaccgctgacttccgttcggcgatttccgcctttgccagcaggttttcagcagttaccgtcgaaggaatgcagttaagcggcatgtcaaaatatgccgtacagccgccggcagcaagcatgtttgagccggtttcaatgccttcccattcttcgcgtccgggttcattgaaatgcacgtgacaatcgaccgcgcctggaaacacatacatgccgtctgcctgcaccacttggtccgcgttttcgtcaatgccgggctcgatcaatgcgattttcccgtccttgacggcgatatcggcccgctctgtcccgccttttcgcacagctttcgcaccctttacaattacgtcataggccattttatcttcctccctgtaaggatgacgattttctgtcagtttttatcacaacatgcgtctatgattgccagtttactgctactatgatcgtaatacatcagcaaaaccgctatattttttgatgatttttattcatattaactaatggttgtctttagaacctgaaaggagattgactgatgaacatttatgatgtgatgaagattcccgcttatgagcgggcggcattaatcgcaggcagatccggcggctggagggaggtgcagcacgtcaacatgatggatgcgccggacatcgctgattttttacataaaaatgaactgctcgtcacgacggcttaccacttgaaggaccgcccgcagctgttgaaagatttgatccgcctcatggcaaaacggggctgcgcgggactggggatcaaaacgaagcgttatcttaatgtcattccgaaagatgccgcggagcttgccgaccggtatgaatttccgattattgagctgccggaagacatcaggctgggagatatcgtcaacgccacactgagccatattcttgatatgcgttcaaatgagctgcagcaggccatttacacccataaaaaattcacaaaccacatcatgagcggcaaagggctgcaatccctgcttaagaagctctcagacattctccggcttcccgtgctgcttttggatcagcatacaaaactcttatcatcgtcccacagcatacccattgacacgtctttattgaaaaacatctgttattccctttccggtccttatttcacctgcttttccatgctctccgacagaaaggcgtattctgtcctgccgattctgaatgttgaaaaaaactgcggttatctggtgattccggagctggtgcagaccgctgataaaggcatgattttgacaattgaacaggcggccaacgtcatttcctttgaactgctgaaagaaaatgccgtcaaacaattcggcagacgggcgcgcaatgaatttttcagcaatttcatcgaccgctcgtttacaggccatgaagaaatcaaaagccgtgccaaagaattccggctccgctgggatcagaaatacatgtgcatttgcggaaaactcgaccgaaatgagaaaacgatcagctttaccgaaaatcagctcgtttccgatcatgtatttgatctgcttgaaggggagctgtcatcctttccgtttccccctcatctctttattaaaggaaatgtcggtattcttttaattgaagcgacagacagctggaatgaaatgcacgcgtctgtcatcagctttttggagcagtttcaaaagcaggtccggacgcagtttaaacggactgtctcctttggcatctcaaacatatgccaaaagctgatcgacgtccctgacgcttttactgaagcttcagacgccatttcatccgggcatttgtccagaagcgcggagtttattcaaatctatcatgccaaagacgtgccggagctgctccgcctgcttccggcggaagatgtgaagaagttttacgaagccaccctccaaagcctggccgaccggcaaaaggaagatcagagcctgcttcatacgctgtctgtttacctggagacccactgccagatttcagaaacggctaagcgcctgtacgtccatcgaaatacggtgatctatcgtttagaaaaatgcgaggaactgctcggcaaaagcttaaaagatccggagacgacgatgcgcctgcggctcgcgctgagaatgcagcggctgatcggttaaggaatcgttagagacagggatgcggggtgttctcccgcatcctatttaaggtgaatcattcagctaaatcctcaaaaaatgctgccatcaaaaccctgacgagtatcctttcaggaagccgtgagcggccttctcaatttctgcagctgtcatgaaatcctcgtgagcatccacggtgtccggctcataaacgataccgtaaacaagtttttgtgcgtctgcttctttcgcaaggatcttcacttacctctcttcctcaaaataaataagtatcatctcaaaagatgatacttaaattagtattttatctaactgtttggattcctccaggagtgagttgactagccgaaactacagctgaaccagctatacagtttccgccaatagacaaaggaaatactatagtaacaaattcttgacctgctggtgtatactcagacctgtgtataaacacacgtgtaccagcagtaagcaaccgtccatttggcaaagttagattaaaaaggagagtgtgaaattgaccaattaaaccttcaaaagcacgactttccccaaaatatgggtaataataatttggatacattgaacatttacctctttcctatataatgaattcaccttacaataattgtatattccatatatttaaaattcgtgtgtggaacaaaaggctcatttcctacgtatacagccgcctatacgtctgaggtgtcacgtctcgttcccatgatttcttcccaattcctgttcatctgcctttgtagaaggacttaacacttttttaagctgctgtttcgtgtcagcagataaaacgtctctcatcttcatctttctttcatttctccttgccgaataagcaccgccttacgctattcgcttttatttatttgcggcccgccgctttattcctcagaaggtaagcaaagaaaatgaagagccggtttaaaaagactttccttgcaatgagatttcactgcttgtgttccccgtgactatccgcgcacaatactgcatacttcagtcgccctcccgagaaggcactttcattgtttaaattttgatacgcagaaatgacttcctcctaaaggaaagaggaaatgctcttttcctttttcacgcggagttttggctacgctgatacattctccgttcacagcggaaaaaatctctccaaaaaaggaggggcgcttcccctccgtgaaccgtaataaagcttcgtgtgttgactaatggctgtctggataatggtctcactgtcatcttggaaagatcacttacttctataagtctttctttttaacagaaaccgcagatatagcagcagaaataactatccgctccgcttcttatgcactctctgtaacatggagaattataaaaaggagggcgcgcggaaacatagggagagctccctgaatgagtcaattgatgggcccatggataataattaaattcttgccgctgatacaaatggaatgacgggtaataatacaacattttcaactccttttccgtacaccatattgtacttaccgacaccctttttagatgattgtctcttgcataattgtgtgttggcctaattgcgggttttaatctgcaaaattcgtgcaggagaaccatcacaacatcttccgtgagaggttataagataacctctccttgttgtcaccaatcgccccctactgaacagttcgtattatttcaatgacccgttttatcagaatgctctccccctgcatacgaaacaactggttcgatatgattttccctctatgcgcatccctgcaatttcagagatgcagaccgccgcagaataaacgacaatcaacaaaaagcctccggatacccggaggcttttgattcttatccttgctgcgtgaacggccgggtctgtgtctttttgccccagccaagcgcggccagaaaactgatggcgagaatggccgctcccagcatatacggaaattccatatttacatcaaagagaaaaccggcggctgacggtccggcgatattcgctaagctgatgaatgaggtgttcatcccgccggcaaacccctgctggtcaccggcgagcttcgacagcatcgtattaacggccggccggagcagcgatgtcagcgtcaggaaaaagattgccgcggcaaaaacggcccaatatgaacccgcaaaccggcaccacacaagtcctgcagcagccccgatcaacgtcacgttaatgacgcgcttttccccgaacctgcggacgagataactgacgccgaccgcctgcacaaacacgccgatgagacccgcagccgtaataataaaggcaatatcagaggctttaaatccgtgtttatggtcaacgtaaaggccgaaaacggattcaaagttcataattccgaagttcagcacaaaaaccagaatcagcataaacgcgatccgcgatttgagcgcgcgtgacatttgcttaaacagatgctcacgtttttccgtttttgcccgggcttccagctgcttttcacgtccaagcgtttcgggcagaaagaaaaatgaaagcaccgttgaaaagcaggcgagacttgcggacacgataaacggcacagacatgccgtaatgaaccaaatagcctccgacaccgggcccgatgacgacaccgagcgtcatcgccgcgctgaacagccccattcctttcccgcgttcttcttcggtcgtaatatccgcaatgtaagcgaacattgacggcattaaaaacgccgcgcccatcccgcccaaaagccgggatgcgaacaattgccacaggcttccggcaaaggcgaagatcaattgtgacacggcaaaggcggcaatgccgaaaataatcagtttccgccgtccgtatttgtcggttatttccccggcaataggcgcaaataaaagctgtgtaagccccgccgctgcaacaagcagacccatcgtgctccccgtcgctccgaattcggtaatatatgcgggcataatcggaataatcaatccgattccaagcatcgcaataaacatattcagcattaaaattgacaatcggcctatgtacgccatgatttcttaccttctccccagacaaacagatgatcattccatatttgtcattttttataccattcagtataacggggaaaagggaaaaaagtccagatgatttcaatctcgttttcatatctcatgacagcacaccggtttcagccggcagatcatatatgttaagggccgcctgcagcgcttccccggctttaactgcaactccgtgtctgatcagaaccgcttcaagtccggccagcacaaacagcacattttcctttctgcagctgtagcccatcgttccgattcgccaaattttcccctgcagcggaccgaacgagctggcgatttcaattccgaattgagacaaaagcatactcctgatcgattcgccgtctgcttccggcggaatcttcacacatgtgacgacaggcagcttcgcctccggatcgccgaataaatcaaggcccatcgctgcaagtcccgccgtaagcgctttttcatgacgctgatgcctgcggaaccgttcttcaagtccttcttccaggacaaggcgcacaccctcccgcagcgcataaagcattgctgtcgcttctgtatggtgattcagccttctttcactccaataatcttcgagctggctcagatcaaaatagttgctcgtaaccggccgatgaccggacagcattttaccgtcagctgccgtcgcaatgccacgttctacctttttacgcgcggcaatgacagctgccgtccggtcattataagtaatcggcgccattccggaagggaccgataggcatttttgcgttcccccgatgactgcgtcaatcttccattcatccgtttttacggcgcatccgccaatcgtggctacggcatccacgataaagagtgcgtcttgggcgcggcacgcttccccgatttctttcagcgggtgaatccgccccgttgatgtttctccgtgcaccatagcgacgattttcggggaaatctttttcatctcgctgataatctcttcaggccggaagaccgttccccattcacactcgatcgtatgaacgtccgctccgtaccgctcggcgatttcagtcagcaggtatccgaagcgtccgtatatcggaacgagcacgctgtcgcccggttctatcacacttgcgagaacagcctcaatccccgctcttgatgtgccgtcaatcggataggcccagcggttttccgtttgaaacaattcacggagcatttgcatcgtttcgttcatgatgccggtaaatgccgggtcaaactggccgaggatcggagcgcccatcgccctcagcactctcggttcagcttctgtcggtcccggtgtcataatcgttctttgcggaatgcacaattcttttctggtcggcacgccgattccccctttacgttaataggcaagtttatgtaatacattcgccagcgtaaggacgccggtttcaagctgatgtgcgggtgtgaattcaagcggcgagtggctgatcccgccacagctcggcacaaacagcatgcaggccggaaaggttctgccgagcatctgggcgtcatgtcccgctccgcttacgatcttctccgggtccgccccctgctcttttgcagcctctgctgcggttcgtgtcagtgtctgatccatttgaaccggctctatcctcatatattcatcaataacaggtctgactcctttgctgcggctgatgttttcaataatcgacaccagtttctgacggaaggctgccagcacgtcttcctgctggtggcgaatatcaacggaaaactggatacggcccggaatgacattcgccatattcggctcaaccgtcattttcccgcacgtcaggcggagctcttccggctgtctttccgctgagagcatgagttcatggatgatgctgcttcccgccgcgagcggatctttccgccatttcattgaagtggtccccgcatggttgcattcaccgtcaagcgtaacggtatagcgcctctgtccggcaatcccggtgacaatcccgatatcctttcccgatcgttcaagcgtttgcccctgttctatatgaatttccagaaaggcactaatatcagtgcgcagcggcgccggataacggcctgcaccgaagccgttctgccgcatggcttctttcagagaaatgccggacgcgtctttcggcgtttccgcatctgaaagcgagaaagcaccggtgatattgcctgagccccaataggtgatgggaaaacggctcccttcctcttcacagagcgacacagcctccagcgtttttttcggacgcccgcacgtctcatgcaaatgccggatcgccagcatgcccgccagcacgccgaacgcaccgtcatatttgccgccgtcaataacggtgtcaatatgcgacccggtcagaatcacctcatcaggcgattctgtgccgttcagccggccgaatacgttaccgacatcgtcaaatgccgtttccagcccgaacgcctccattttctttttgacggcaagctgggcgttcatccattctttcgtatataaaagcctcgtcactccgccggaagcggaagcgccgaattgagacagccattgtatgtcgtcggaaatcccgatattcgccgccgaaagctgctgatgttccatacacgccctccttttaaactgaaaaactgacaagatgatcttcattatagaaggagcgcattatgagttcattatcatatcctctaaaaaatcaatgattttccggatactttgaccaagaaaccgcccctctgtcccataagccgaaggaaccatttttcaaaaaagatagaatattagatttattttttggataatagaggtaaaggagggcaagtcatgacaaaaaaactttggtttctgccgattgtctgcctgtttttcatttttggatgggccgcgccgtcagcctctgcgggcgcgccggctgacacaaatctgtacagccggctcgcggtttcaacttccggcggcacaactctttttccgcaaactgcctcagctgtcatcactccgtctgcggatacggacacatattacaaagaagcttccggaaaaagcggaacagccttaaagagcgccctgcaccgcatcatcagcggacatactaagctgtcttacagccaagtatggaatgcattgaaggaaactgacgaagatccggcaaatccgaacaatgtcatcttgctctacacccaggaatcacgggccaaaagtaaaaacggcggcagcgtcggggactggaaccgtgaacacgtgtgggcaaagtcacacggaaacttcggaacagctgccggccccgggacggacattcatcatctgcgccctgcagacgtccaggtgaacagcgccagaggaaacatggattttgataacggcggcacagaatacccgaaagcgccgggcaattattacgacggtgattcctgggagccgcgcgatgaggtcaaaggagacgtcgcccgcatgctgttttacatggcggtgcgttatgaaggcggcgacgggtatcccgaccttgagctgaatgataaaaccggaaacggctcagctccttacatgggaaaactgtccgttttgctcaaatggaataaacaagaccccgtcgacagtaaggaaaaacggcggaacgaaatcatttacgaagactatcagcataaccgcaatccgtttatcgaccacccggaatgggcggacgaaatctggtaatcgtatcataagaagtgataagggagccccatcatcaggctccctttttcaatatacggcgttttcagtgtcggcatcaaaaaagacggcccggttcatattgaccgcaagcagaatggcatcgccgggtttcacctctgaagcgccgtcaagacggatcgtcatgcggttatctccgctcaccgcatgaacgtacatctccgcgcctaagttctcacatacttccgccacagcgcggcacaccgcttcaggcgggtgctctgattgtccggcaagcgtcaaatgctccggacgcagccccgcagtcatctccttaccgctgtatcctttctgcacaagaacagccgctttttctttcggaatgggcagacgaacggacgaaccggcaaaataccattgcccgtgactttcttctatgacgccttttataaaattcatactcggagaaccgataaaacccgccacaaacatattcgccggataatgataaatctcatgggggcttgcggcctgctgaatatctccttcattcatcacgacaatccggtcgcccattgtcatcgcttccgtctgatcatgcgtcacataaacgatggtcgctttcaaacgctgatggagcttgctgatttcggcgcgcatcgtcacacgcaatttcgcgtctaagttggaaagcggctcgtccatcagaaacactttcggctcccgcacgatcgaccggccgagcgcaacccgctgccgctgcccgcctgaaagagccttcggtttccgcttgagcagatgcccgatttccaaaatatcagcggccgtccggactcgctttgtgatttcttttttcggcagctttctgagcttcaaaccgaacgccatattatcaaacaccgtcatgtggggatacagcgcgtaattctgaaaaaccattgcgatatcacgatccttcgggggcagatcgttcaccgcgtctccatcgatataaagcttcccttcagaaatgctctccagtccggcaatcattctgagtgtcgtagatttgccgcagccggagggaccgacaagcaccagcagctcctcatcctttacatctaagtgaaaatccttcactgccgccgattgggcgccgtatgtttttttgatatggtcaaatgttaatgatgccattcgaaacctcctccaatactggaaaccgccacatctttctgttatgttaaaaatgttcggggtttctgacagattcataaatgaaaagcaaatttgtattataacgtcataatacgtataatagtactactacttgacaaaggaggtccgtcccattgttaaataacgggagctcgaaacctttatatattcagctgaaacaaattatcgcggacgatatcaagaagggcgtttattcgccgtccgtaaaactgccgactgaaaatgagctgtgcgaaacgtacaacgtcagccgcataacggtcaggaaggccatccttgatcttgtggaagaaggctggctcgtccggcagcagggaaagggaacgttcgttaaaagccctaaactgaagcgggagctcatcgcggtcaacggctactctgaatttatggaatcaacgggaaaaaaaccgaaacaccagatcctttcccatgaaatcattgaagcgcctaaatccatcgctcaaaaacttcgcgtcgcttccgaaagtcccgttcttgaattaaaacgcattttatttcacgacgaccagccgctctcattcgaaatcgcccactatccgctcagtttatttcccgacatcggcaagcatattaaaggcggcgtgtcgatgcatgacattttgaaacagcactatcaggtggtgcccacccataatacgaagctgttaaatgtcgtatacgccaagcaggaagaaagccgctatctggcttgtgatatcggggatgcgctttttgaaattgacaaaaccgcttttatgtcaaaagaccagccgatatacagctcgctgtttttaatgcataccgaccgcgttacgtttaccattaacagcccctatgcgtaacaagtataaaaaacgagacaatgcttatcgtattctcgttttttcactgcttttcccgccgtccggcctgtagggatgcccgtaaccgaacgctccgaaccctccgcatgttttggcagccgtcccggcggccgcagtaagcgctcgccgaatatcctgatgctcgaagaaatcggtaagaaacccggcaataaaagaatcacccgcgcccaatgtatctattatatcagctcttaccaccggctgatgatagacgcgttccccatccgataacaccgcgccatgttctccccttgtcagacagacgattttcgctccgaaaccgcgggctttttcggcaagccgcacacattcactttcagtcaaatcactcccggaaaaaaacgcatacgttacgtacggacagaccgcttctaaataggcttcgtcacgttttacagagaagtcaaaggaaatcggcacatggccgctcagcatcggaaggtcacgttctatcctgctgtatacgctcgtatgcagcagatcatgtccggcgataaatgagatgtcattctcctgaaaagcgagcgtcagacgcgattgcacgccgcctttatttgatccggcaaatatcctgtcccctttttcatcaagcgtgacgaccgccatcccgttttctccgtatgcccggcggatcagatcggcattcaccttttccagtttcagcacattcaatacgtgatccgccgcttcatcactgccgagaatcccgatataagaagtttcgtggcctaagcgccgggcaagcacggctacatttaacgcatttccgcccgggtaaaacgtctcctgatcctgataataatctactacattatctccggccgctatcagtttcatcttttcatcccccttatcctttcacgcttcccgctgcaatgccgcggataaaatatctctgcatcaataaaaacagcgcgatgatcggagcagcagaaatcgtcagcccggccagcagcacgccccaatccgtctgcagcgcatctctgaactgcatcagcccggccggaatcgtccgtaaattttcatcatcgataaaaataatcgcaaacataaactcattccatgtatggtaagccgtcaaaatgcctgatgtcaccagaatcggcacgctcataggtaagaatattctgaaaaatattccgaaacttgtacatccatccagataggccgcttcctcaagctctttggaaatcgacaaaaaataggaacggatcagaatcacggtaaacggaatacggtaggctgcgtacggaagaatcaatgcccaatacgtattgtacagtcccaatgactggataatggagtacagcggcacaagactgacctgcggcgtcagcatcaagccgccaagacaaatgatcagcacaaacccttttcctttaaattgaaaacgggccagcccgtatgccgcccaggcactcacaaatacggtgattagacaagtcagcacggtcacaatgacgctgttcataaaataagcggaaatcccttggttccatgcggatacgaagttttcgggatgccagacagagggcagcgaccagctgtgctcaaaaatctcatccgagcttttaaaggcgctgaccgccatccataacagcggataagcaacggcaatgaggtagataaagagaaacagccacacagacgtttccccgacataccattttctcggtttcccgcctgttctgacggcctgacgggcatgacgcaagtccgtcttttcaggaagcatcggctactcctcctttccggtcttaaagaatttcatctgaataagcgacagagcaagcgtcagcaaaagcaccaccgtcgcgatcgcagaagcgtagcccatcatatcctttgtaaaagcgctcttatacaaaaatgtgctcagtacttctgaagcattgcccggtcctccgccggtcagaatatacggttcattaaatacggtaaatgcgccggtcagcgtcatcactacggcaacaaacgacatttctttcgtctgcggcaccgtaatgtgaaaaaactgctggatttttccggctccgtccagctgcgccgattcatataattcagcgggaatgctctgaatcgagacaatgtacagcatggcgatgtaaccgacagactgccattgagacacaaaaatgacagacagcatagcggtgttttcatcgcccagccacgcccgggtcagttcatcaagtccgacggcttccagcagctgattcaaaagcccgatttccgggttataaataaaatcaaacaacagcgcaatgacggtcatggaaatgacgaccggaagaaaaaataccgtacggaaaaacggcgaccattttcttaccaatctgtcttccagcacggccgccagaattaagccgccgccaacctggcaaatcagcgatatgaccgcatatagcacattgttgcggagtgctgtaaaaaacacgggatcgtggaacaggtcaatataatttttcaaaccgataaacgtcttttcgggttgaaatgagctccattcaaacagactgaaaaacacattctcaataatcggaatgtaaacgaacagcagaaaaaccagcgcgggcgcgagaaacaaatacggaacgaaacgttttcggctgaccaaggaaatcctcatctcctttctccaaagaaatctgttctattcagataacgctttgacctgacgcgccgctttttgcacggaattcatcacctcgcgcggtgtcattgtgccgccgagcatctgctgaacgcctgccgcatacacatcggcgatttcaacgtcaacatccatatcaaaccacggcaccattgtttcggcgcggatgatatcctgcacggcttcgcgctggatcggggtggaattgttttctgtcgccgttccctgaaccgcgctgtatttaccgacgtcttttatcagcttctctcccatttttttcgaggttaaaaactgaagaaattccatggcttctttcgggtgcttcgtttttgaggaaatcataaatccttcgggagatccggtcagtgcacggggagatcccttttcgccgctgattttcgggaaaggaaacaagcccagattgaccggttcgacgagcttaatttctgccgtttccgcataaatcatcgccgctttgccgctcgtaaactgctggcgcacgtattcgtgatcaacggagttcacgtgctttgtaaagtacggcagaagttcctgaagcttttcaagcgctttgacatagccttcgtccgtaaactccccggtttccgggctgtaatccttcgcccgcgttttttcatccaccatacgctggttcagcgtcccgatataatgagaaatggtccaaggcgcttttgtgccgaaactgatcggaatatatccgttctctttcaatttctcacagactgtgatcagttcatcccatgtcgccggggcttcaaatgtaatgtattaaaaatgtccttattataaaagaatgatttagcgtccatttgccacggaacaccgtactgttttccgtcatgcgtaaagggtttgatttgtgactgcacaagctgtgaggaccaatctttatcctgctgatagtaagacgacagatcgagggctttatctcctttgatgaatttataagcaaaccggtcgctccaagaaaagaaaatatcaggggggctcgttgttccgagcatgactttcaccttgtctttataagaatcgttcaagaccgcctccgtttggatatgaatatccggatgagcggcttcaaattctttgaccgcttcttcaaaatagcttttttccggctccttcggccacctgtgaaaaaacttcagggtcacttttccgtcagaggaactgctttggcttgaacaggcggcggctgacagacatacagctaacagaacgaacaggcagatgagctttttcagatgcttttcctcctttgtcaccggactataacgttatatatcattatagtccggtgaaatataatgcgcgttcttaatattcgactttccacatgtaacgccgctggcttaacggatggttccttgcttccgccagcgcatccgcatagcttctgagcacccggtttaatacgagaggagccagatagccttttacagaatcgtcaatttcggaaaaatcatatgctgccgcatcaagcacagtcagttttttgccgtatctttttgagaaggaaagcgcccgctcttcaaggggtcttgtttcgtctaagccgagcaggataataaatggaacggattcatcaatgatttcgaacggtccgtgaaaatattctccggcatgaatggcgtgggaatgaatccattgcatttccatgagaatgcagatgctgtaggagtaagcgacgccgtagttcgcaccgcttgccatcgtgtaaatgatatcttctttttcgtgggctttcgcgaatgcctttgcgtgatccgcttcttgtttaagcgctttgtcatatacggtctggagcttattgagtccgtcgatcgcctgctcaaacgcgggatggttttccagcacgtgtaaagcgccgaacacgatttgatacagaaccccgtaattcgtatttatcgcctgtgcgttctcaccccagtcatacaccgcgacatattcggcttctttcgctaacggcgaatcaggctcaaaggtcatcgcaatcgtaagcgcgcctttttttctggcgaaaccggcggctttcaccgtttccggcgtattgcctgactgagaacataaaatcacgagagagttctctccgagctgaatgggattgcgctgaataaattcatttgaactgtagagatcagagctgatggctttcgcctctctgtcaaacacgtacttgctcggatacataatggctgaagaacccccgcaagcgacgaaaaagacgtggtcaatcgtttttcctttcagatcatccaagaaagcctgaaccttgtgattcacttgtgcggcagtttgactcaaatccttcactcctcagtgttttattatataatgttatataacattatataacgttatattaatcgcaacaaaggtgcgttgtcaatcatattttctgaaatttctaaaatataatataaaaccgtcttatttcccgccctctcttgacctgacccttagagacacgtttagaatgaaaagcagggagtgattcagaatgaatataaaagaagcagccaggcagacgggtctcacgaaaaaagccatcaaatattatgagcaggaaggtttaatcaccgtcagcaaaaaccctgataacggataccgtgagtattccgctcagaacgtgaatacgctgaaaatgattgccgccctccgaatgctggcactgtctgtaagcgatattaaagcgttcctcttagagggcagcagtctgcatgatatactgcgccagcagcatcaaaagctcagccggcagattgaagagcttgagcaggaacggaaactgactgaaatgctgatcaagcgcgtggaagatgcggaaaatgtcgattcaattctgcatgatatcggcgaggtcaaaatagatgaaccgaagtatatgggacttcagctgaaaaaactgttcccgggagatttcggagaatttatcgccgcgctgtttgaaccgttcctcgacttttctattgatacagatgagaaaaaaacgatatgggcaaagcttattaaagtattggatgatatggaagaagttccggctgcacacccgatgatgcagctggtcggcagggaggacccggctcagctccagcagcacaaagtccagcatgaccaatttatcgagcggattttggagagagaccccgccacttgggacactcataaaaacatcatcattcagcttgtgaaaagagtgcagacagatgaagaatacagagaaagcctgatcaaggtcggagaatccgcttctgatctgcccgcgctgaaggaaggatcgcctttcagcaatctacttcaaaagctcagcccgaaatatgacacgtatgtgcgacttcagcttgaactgaaaaaagaagccgacgaggaactcggctttgattcagaagcatatttaaaacagatgcttcaatcaaaaaaacgctaaggttcgtctccttagcgttttctttcttcagcctcagtgctgcgcgttaatgcggtcaacgacattagcgatgagctgctcttttcctaagtcggaatcttcgtcaacgcttgctactgtcaaaatgatagccgctaccgcaagagcgatcgtctcaatggcggccgccgcgtttaaaaatacccatacagccgttgcgcattggccgatggccgttgattttcctttatccatgctctttttgtcaaactcttctttcagcactttcgccataatctgcgaaccttgatcaatgacgctgttcactttctcataatcgccgctgtagaccgccgcttttaactctttaaaataatccggcgatgactttttaatatcagcaatcacctgatcggaaacttgctttaattcatcctgatcaatctttttaacagccttggtatcccatacttcaggaaggagctttgcgacctcaccttgtccgaaaaagatgccggaaaaaatgtcttcacccgaataagagacggacggctcagtttttgccgcggcatgcgggccggctaatgcgaccattaaaacaaacaccagcatcatggcagctgcggacttcttgcttttaaccatataatttcctccttttccttttattgaaaaaattgtatctgataaaaaggggattgtaatggttcaaagctactgttttctctgccggcaccaaaaacaggaccaaaataccagccaccgtaatggaaaacgaggtcagtcccagcataacggcaaagatttcgtgcataaaaatggatataaacaatatcggacgccaatatgttttcggagcgaacaaagcgcagaacataatggtttgcacaatgagcgtgccccaagtcgggatgatgacaagcttggactgcaggataaagtcaaacagaccgtgaagcgcatccggcagacccagcatcggatcattcaaatagtaataaacggcggtcccgttctgccactcttcttccatcagtttggcaatgacagagttaaagtacagcatcgcgacctgtattctgatgattgtcagtgtggcccagcataaggagcggtaataaggctcaagcggccttttctcaaaagacgcctcgtacggagaccagtgccatttccgcggatcggttaatgtcagcgggagcagcagcagcgtaaaaacggcagctacttgatctcccccgtcaagggtaacggcggagttttggaagctgtacgaaatccaccagtgaaaaaaaccggtgaggcggggccgccagccaatgacgacaaggattaacatacagatacagacggctttgacgatctcaatgtaacggaaatcgggaaacagcagaaacaggctgaacgtgtcggaaaagctgagcatttgattttgcgttttgaagaagacagacgccggattgaacagcaatgtcagcagcgtgccgagcgcgattaagcttctggcaagcccgtacacatttgtccaaggcggattcttcatcatccataaggtgagctgcttttttgcatcctgaatcaattgacatccactccgatgtattttttgatggttcttttcgtttcggtatgctggctccatgcccatggggtaatgcgttcatatgtaatgatcattttccctttcagccttggggagggagactcatttttcattttcaaaaatgtggtatccttaatgtcttggccagtcgtgaagtcttcccacttctctttggaaggcagcttttccagcataaggccgagctctatcccttgcgtccggccgtaacggtttaagccgatcacatttttcagagaattattcggccatctgagctcctcatcggcatcaagaagatagatgttcaagctgtcttctctcggatctttactgaaaaatccccagctttgcggataaatcatggaaacggttttggattggtgcttggttaattggatggcggagcttggcagtgccgcaatgatggtaaaaaacaaaacgatgatccagacggccatgataaaaagaaagaatgaaaacatgctggtttgcttcttgtcagtcaattgaaaccctcctagcgtatggaaatttcattgacatgattatacaccatccaacaggtaaaatattgataaattagatttttcagactaatatactattatatgtaaaaaaagggagtgttcatatgtttttgatgaatgataaggtgctgtggggagctgtgattctcgcctttattctgtcgattgtgttttatccgtttcttcctgctgatatggccattcactatgacgtgtcgaaccgtccgaatacatcaatcaataaaacggccggcgtcctgatttttcctgtgctcatgatgatctgcatgttattcagaaaaaaggtcgtccagctgttcctcgtcgtttactgtctgctgatcgtgcatattgcagtgatgtggctggcactgtaaacataaagaaaaccggagcccttaagctccggttttccttatttataaaatactttctcaatgttgtatttcgactgaagggtattgatcgcgtacgtttcgtaaatctccctttccatcggatcattgacgacacatacttcaattttatacacttcgtccctgtgatgtttaacaggcgacacattgtcttcaaaatgctttttgattctttgtcttaatttacgggctttcccgacaaacagcagctcatcatgaatgttataaaacataaagatgccgcctttgtctctcggaatttggtgaaaatcaatgaaaccgtaaatcgctttaatcgccggttcattttccgacggtgactgctgccgttccgtaatggttacatcaggagcaggaaggtttatttttatcaaaatgggtcacgtcctcttattcattaaagctccatcctatcataagaatgcgccaaaagctattttttattcaagcgccccggccggatcataaaggctcaaatcaatttccgtctgctgcccgagcgcgagtttcgccagttcagcccccagatacggcccgctcgtcagtcctgaggcgcccagcccgttggcaacgaggagtccgctgatattcggcactttgccgatgacgggaagaaaaccgggagtaaacggcctgaaaccgactcttgtctctatcatagtactgtctgaaagccccggcgccacggttaatgctttgtcaaaaatctcgcggaggccgccggccgtcacccgcaaatccatgccggtatcgttttcatgagtcgcacccgctatgattctgccgctgtcaaaggcgagaatgtattgatcgtttgggggcatgacgacgggccagccgcccgtctcctctccctgaagctctaaatgaacgatctgcgccttttggtatgatactgaaaaacggatgccgagcggttcaagcagctctctcgcccaagcgccggccgttacgagaacctggtcggcagtaagcgtgcgttctgcggttttcacaccgatgacggcaccgtcctctgtcaatattgacgtttcttcattgtaaacagcagctccgtgcttaacggccgcgtttaacagcgccttacgaagcgccctcccgttcacccgggccgcgccgctgacatgaaccgcaccgtattcctccgacagcgcgggaaacaatgccttcgtttctgccggtgtcagtcttgtaatgtcaccgatttcaggggcgtcctctcttcttttataagccctttcctccatttggctgagctttttttcatccgtatggaggctgacggcaccgaccttttgataaccggtgtccgtttctccgtcagcttcaagctgctgtatcaattggttataatagcgggctccgccttttgcgatcgcataccatgcctgattgcggcgctgcgacagccacgggcagacgatccctgccgcggcgtcagtcgcctgccccgggtgtttcctgtcaaagaccgttacatccgcaccggcctttgcgagatgataagccgcggacgcaccgagaatgccggctccgataattatataagacttcatgtgtaacaccttttctatctgttttgtcttatttattttaacaaatggagcgcccggttcctaccggagtcctgacggcgacaatgagttttgaaaacggaaacgtataataaaaggaatatgttcttgtgtgaaagccgttttcctcaagaattgctctgtattgtgatgtattttttatatctgacacggccaatgtgccgccaggcttcagcaccctcaccatttccgtgatcgcccgttccctctcttttctgcctgaaatgttgtgtacgacaaaatgcgaaatgacaaggtcaaacgatttatcaggaaacggcatggcttgcgcgagtccgtcatacaaatcaatttccagcgctccttctgcccgtctgttcttttcaaatgcgtctcttccgtttccgcccagatcccagcttgaccatttgtcaatcgctgagacgtcagcgcctttttgagccgcggcgatggctagcagcccccgtcccgtcccaatatcaagcactttcatgtccggctttaacccggaaagcgcaagaatgcgatggcggtgtgaaagtttaatggccgttgaatacaagagcatccaaagaccgagcactaaaaacaaggcacccgtcagccagccccagaaaagaggaatcatgccgtataatgtgcctgcggcataaaggagcgcaagaaagataaatccaaacgctccataaggcgcatcaattccgtatcttgttgtcataacactcacccctttcaatatttatccaaatggcataccatattattctagcaaaagccgaaaggagatacgaccatatgaaacgcggcattacttttgacatcccaaatgaaatcggacggtttgcggcagatatattacaaccgttccccatctcttcctatacatggtttatcggtgatggagaggcgtatactgaattcaatgaagacaccgatacagacctgtttccgcaaaatcagcgcatcattcagggccaagaactccgtcagcgtctggaaggagacccttattatatgatttttgctgaattgaaagctttcccgagcaggatggtaacggaaatcaatacgtatgaggaatatttggatagttcctgtgaacttgtgcttctcattgcagattgctcgtatgtaacgttatattgcaaagatccggacatgctcgaagccctttttcagcaggctgtacaatgcgggtttcaccgcgttgactatgttacagatgagaatgacgcgagaacgggattgtctgtctgatgaaggtgcgttctttttatgaagcgcctgatagggcttaggattcaaaatattgacaaattcatgtgttttcaacaaaaaaacaacccctcatgtatactgagtgtgtaacttacatatgaaaggggtatggcaatgaaaatcagtttgaagaaaaaagcaggtttttggaagaagacggcggtttcatctcttattttcaccctgttttttgccctgatgatgagcggtacggtttttgcggccgggctgaataaggatcagaagcgccgggcggaacagctgaccagcatctttgaaaacggaaagacggaaatccaatacggatatgttgaagcattggatgacggaagaggttacacctgcgggcgggccggctttacgacggctaccggagatgcgctggaagtagtcgaagtatacacgaaagcggtgccgaataacaaattgaaaaagtatttgcctgaattgcgccgtcttgcgaaggacgaaagcgatgacatcagcaatctgaaaggattcgcttctgcctggcgctcacttggcaatgataaagccttccgcgctgctcaggataaggtaaatgacagcttgtattatcagccggcgatgaaacgttcagaaaatgccggactgaaaacggccttggccaaagcggtgatgtacgatacggtgattcagcatggcgacggcgatgatccagactccttttatgccctgattaaacgcacgaacaaaaaaatgggcgggtcaccgaaagacggaacggacgagaagaaatggctcaataaattcttggatgtgcgctatgacgatctgatgaatccatcagatgaggacacccaggatgaatggagagaatcggttgcccgagtcgacgttttccgcgatattgtcaaagagaagaactacaatttaaacgggccgattcatgtccggtcaagcgaatacggaaatttcactattcaataaataaaaaaaccccgccatatggcggggttttactattaaccgatggagccttccatttcgaacttgatcaaacggttcatttcaactgcgtattccatcggaagttcttttgtgaacggctcgatgaagcccataacgatcatttctgttgcttcttcttcagaaataccgcggctcatcaagtagaaaagctgttcttcagaaacttttgatactttcgcttcgtgctccaatgaaatgttgtcgttcaggatttcattgtaagggattgtatcagaagttgatttgttatccataatgagcgtatcacactcgatgtttgaacgggcgccgtccgctttccgtccgaagtggacgataccgcggtatgttacttttccgccctgtttcgaaatcgattttgatacgattgtggatgacgtattcggtgcaaggtgaatcattttcgcacctgcgtcctgatgctgtcctttgcccgcaagagcgatagagagcgtcatgccgcgcgcgccttcacctttcagaatgacagccggatatttcattgtcaatttagaaccgatgtttccgtcaacccattccatcgtcgcgttttcttcacaaaccgtacgtttcgttactaagttgtaaacgttgttcgcccagttttgaattgttgtataacggcagtagccgccttttttgacgatgatttcaacaaccgcgctgtgaagcgagtttgttgtgtacacaggagccgtacagccctctacgtaatgaacgcttgcttcttcgtcaacgatgatcagcgtacgttcgaactgacccatgttttcagagttgatgcggaagtaagcttgaagcggtgtttcaaccttcacgcctttaggcacgtagatgaaagatccgccggaccaaacagctgagttcagcgccgcaaacttgttatcagtcggcggaatgactttcgcccagtgctcgcggaaaatgtcttcattttctttcagcgcgctgtctgtgtctttgaaaacaatgccttgcgcttcaagatcttctttcatgttgtggtacacaacctcagattcgtactgtgcagaaacaccggcaaggtatttttgctcagcttcaggaataccgagtttgtcgaatgtctgtttaatttcctcaggcacttcatcccaagaacgctctgaacgctcagacggttttacgtagtacgtaatttcgtcaaagtttaaagagtttaaatccccgccccactgcggcatcggcatgttgtagaaatgctcaagagatttcaggcggaaatcaagcatccattgaggctcttctttcatgcgtgaaatttcttctacgatttcttttgtcaatccgcgctctgaacggaaaatggaaacgtccttatcgtgaaaaccgtacttgtattcaccaatttcaggcatttttttagccatccattttcactccaatcttttaattgccgcctttttcgccagcgactcctttttcaagtgctttccatgaaagggtggcacatttaatccgggccgggaatttcgaaacgccttgaagagcttcaatatccccgagatctatcgagtcgtcatactctttcccttgcatcatgtctgagaaaaccttagacatggaaagggcggtatcaatatcttttcctttaatcgcctgcgtcatcatggaagctgaagccatggagatggagcagccttccccttcaaacttcgcttcctgaacggtatcgccgtcaagcttcattgtcagtctgatccggtcgccgcaagtcgggttgttcatatcgacgacgatgctgtcatccaaaacccctttgttgcgcggatttttgtaatgatccatgatcacttgtctgtataatgtatctaaatttgcattaaaagacatttgtaaagtactcctttgtcttttggagggcttccgcgagcttatcgatctcttcctctgtattatacagataaaaactcgctctcgcagtagcagatacatccagccatttcatgagcggctgggcgcagtgatggccggctctgaccgcaatgccctcagcatcgaggacagtcgcgacatcatgagggtgaacctcatcaagattaaatgtcacaagtcccgcccgctctttcggaccgtataccgtcacgccgtctagctgctcgaaacggtcaagcgcataggctgcaagcttatgctcatgccgggaaatctcgtcgagtccgatctcttcaagaaaatcaatcgcggctcccaatccgatcgcgcctgcgataatcggcgtgcctgcttcaaatttccacggaagctctttccaagttgattcataaagccctacaaagtcgatcatttcgccgccaaattcggccggctccatattctcaagcagttctttcttgccgtacagcacgccgattcccgtcgggccgcacattttatgggaagaaagcgcgaagaagtcgcaatccaggtcctgaacgtcaattttcatgtgcggtgtgctctgcgccccgtccaccacgatgacagcgccattgtcatgagcgattttggcgatctctttaatcgggttaatcgtgccgagcacgtttgacacatgagcgactgccacgatcttcgtatggcttgtgacagtctgccggacgtcgtccagcgaaagcgtgccgtcttcctgcatcgggatatattttaaagtcgcgccggtagcttttactgcctgctgccacggaatgatattcgcatgatgctccatttgggtgatgaccacttcatcaccgggttttaagctggcgcgggcatagctcagcgccaccatattcagtgaagttgtcgtgccttttgtgaaaatgacctcagccattgacttcgcattgataaacttacggactttttcacgcgcaccttcatagccgtctgtcgctctcgtgccaagagtatgaacgcctctgtggacattggaattgtatttgctgtaatactgatccactgcttcaatgacagcacgcggcttctgggaagtcgccgcgctgtcaaggtacacgaggtcatgtccgttcacttgctgatgaaggatcgggaactgttcacgaatatcggtgatattcattattttactttcctttcgatgacggagacgagctgtttcttaactccttcaatcggaagctcttttaccaccggagcaaggaatccgtaaatgactaagcgctccgcttcttctttcggaattccgcggctcattaagtagtaaagctggatcgggtccacacggccgacagatgccgcatgtcctgcagttacatcgtcttcatcaattaagagaatcgggtttgcatctccgcgtgctttttcactcagcatcaggacgcgggattcctgttcagcgtttgctttagacgcgccgtgctcgattttgccgattccgttaaagatggaagatgcggcatctttcatgactccgtgcttcaggatatagccttcagaagccttaccgaagtggatgatctgcgtcgtaaagttttccgtctgttctcctcttccgacaactacggttttcgtatcgccgtatgtgccgtctccgtaaaggtttgtcgtattttcagaaatcgtgtcgccgtcgttcatcagtccgagcgcccactcgattttgctgtcgcgtccgcgcgcggctccgcggcggttgacgtatgttgtgacacctgctgacaggttgtcaacggcgccgtacgtcacgctggcattatcacctgtgaccacttcactgataatgttgaataccgcttctttcggattcaccgtgctgatgtagttctcaacgtaagtgacggagctgtggtcttcagcgacgatcagcacgtggttgaacaatgccgtgtcattgctttcatgaacgtaaacggcctgaacaggcgtctccacctgaacgtttttaggaacataaaggaatgccccgccgttcattaatgccgcatgaagcgcagtcagtttatgttcgtcgacctttacgccgtctttcatgaagtatttctcaacgaggtcgctgtgctcacgggcagccgttaagatgtccgtgaaaatgacgcctttgtctttcagttctttggaaagagaaaggaaagcaggcgtttgatcacgctgcacatataacgttttgtcttcgttttcgatatcgatcagcgcttttgcttcatcagctaaatcttctaaagaagcaagcggcgcgttttctactgtatgcttgttgaactttgtaaagttccaatttgtgatttttgttttatcaggcttaggcagcggcagatcttcagctttttcaagagcctgtaagcgcaggtttttcagccaggcaggttcttgatgcttttcggaaaagcctttgacatattcctgatctacggatagtttcgtttccaatgtcatgattatccccctaacgcttacgcttcttggcctacagtttcgtcttcaatgcctagttcttgtttaatccagtcataaccttccgcttcaaggcgctgtgcaagctccgcgccgccggatttcactacgcgtccctgcatcataacgtgaacgacatcaggcgtgatgtagttcagaaggcgctgatagtgagtgatcattaagcagccgaagttttcgctgcgcattttgttgattcctttagaaacgactttaagcgcatcgatatcaagacctgaatcgatctcgtcaagaatggcgattttcggctcgatcatcataagctgaaggatttcgttgcgttttttctccccgcctgagaaaccttcgttcaggtaacgctgcgccatttcagggtccatttcaaggaactccatgttttcgtccattttgcggatgaatttcataagtgaaatttcatcgccttcttcacggcgtgcgttaatcgcagagcgaaggaaatcggcatttgtcacaccgctgatttcgcttggatactgcatcgcaaggaaaagacccgcctgagcgcgctcgtccacttccatttccagtacatctttgccgtcaagcgtgatgctgccttttgtaacttcgtatttcgggtgtcccataatcgctgctgagagcgtggatttaccggtaccgttcggccccatgacagcgtggaattcgccgccttttatttcaaggtttacaccttttaagatctcttttccttcgatttcaacgtgaagatccttgatcgttaatgttgaagcagccatatctatacctccaaaatatataatcattattctcaatttattctcattctaattttataacaaatgaaaagtaaatacaactttttatattacccggaacattcctaaagtttatcaaagatcaaggcgtaattaaagctgtttgaaacagaaaaagggcggaaatccaccctttttcactgaccgattttctcattaagctgcgctgcgaggaacttgcttttttgatattcaagctccctctgccgttcgacttccatcctttttgaaagacgccgtccgtattcctcgtagccgatgccgtgtgacttctgcatcgctttttccatttcaggcgtatagtcaaggtccagtctctcgtggctggtgcagataatgaatcaatcccttcatatatttgtttctattgtaacaatgatccgctgctccggccaaagagtgtgtgcccctgaatcctttcgaatgtgccggaaaccggcgctcgctttatctgaaaaacggtattcacacgattgctcattctaatgcgtcgtatgtccgaattcctgaatgcactgctgcacgagggtcactccctgactgagagccgcgccgcccccgaatgccgccgcgacgctgatgacctcaaggatgttttcttctgtggccccttggtcaaggcagcccttcgtatgataaatcatgcaaaattcatcttgagcgctgatgctgatgcccagagcgactaattgtttctctttttcagttaatgaatccgctgagaaacactgctcagtaaattcattaaacttccgccccatcatcggcattttttgctcgaatatgcctaaaccttctttatattgtttcaatgcgtcatgcacgctttttccgttatcctggtattgagccactgccattccctccaatcgttaaccttcctttttattatggacagttctccgattaatacccgaaaaaaaccccggatggatcatccggggtttttcgctttattcagatacgggaagcacggctccgtcgtattttttctcaataaagtctttgattttcttagagtgaagcacttccataagcgctttgattttctctgatttttcgtcacctttgcgtacggcgatgatgtttgcgtacgggttgtttttcgttgattccacttgaatcgcatcttttaacggattcagtttgttttgaatcgcatagttgacgttaatgaagactgcatcgccttcttcttcattatatgctttcgccgttaattcaggggcgatttttttgaatgtcaggtttttcgggtttttcgtaatgtttttcgtcgtcgcttcaatcgtttttaccttcggatcaagtgtgatcagtccggctttttcaagcatcgccagcatacggccttgttcagcgacattgttagtcatgatgatggtcgcgcctttaggcaggtctttcagtgatttgtattttttcgtgtaaactccgaatggctcaaggtgaacggctccggcattcacgagtttgtaatctttattttctttcatttcctgttcaaggtaaggaacgtgctggaagtagttcgcatccacttcattatcagctaacgctttgttgtacattttgtaatcgttcagcacttttacttttaatgtgtagcctttttccttcaagagcggttccgcttcttttaagatttcagcatgcggtgtttttgtcgcggcgacgacgatttcctttttattcgagccgtttgatccgcaggcggctaaaactcccgcgaacacaagcagcagcgcacttaatacaatctttttcaatgtaaatcctcccttatcttttgtctattatatttgtaattacatcaccgataatctgaatgataaagacgatgatgagtataaatactgtcgctacaaacgttacatccgtattattggactggtagccttctacatatgcaaggtttccgagtccgcctgaaccgatagcgccggcaatggcggtagatccgatcagggcgatggccgtaacggtgatgcctgaaattaacgcaggcattgattcaggaatcagcactttgaagataatcgtcgatgtctttgctcccattgatctggcagcttcgatgactcctttatcgacttcccggagcgcaatttccgcaagacgggcgtaaaacggcgcggagccgataatcagcgccggcaatgcggcgttcggtcctaaaatcgacccgaccaaaatcttagtaaagccgagaagcagaataattaaaataagaaacggaatagacctgaaaatattaacgaccgccgcaatcacggtgttaatgattttattttcccataagcttcccttgcccgttaaaaagagcagaagaccgagaatcgctccgatgataaatgaaaaaactaaagcgatgaccgtcatataaagggtctcgtatgtggccgtccacagctcggttatatcaacgttcgggaaccatttttcaaacatttgtgatcacctctgcttctacctgtttgtctttgatgaaccggatcacgttttctacttctttttcctgaccgtcaatatgaatgaataatgaaccgtaggctccgtccttcgtctgtgaaattttcccctgcagaatattgacgtccacatcaaagtttcggatcatttccgtaatgaggggctgctcggcggcctgcccgacaaatgaaagctgaatcgttttccctgtcgctgtttcctgcagaaaatgctggatggtttctttcgtctcttccggttctgtcacctgctgaacgaaacgcttggtcatcggttcgcgcgggtttctgaaaacttggagtacttcgccttcttcaacgactttcccgttttccatgacggcgactctgttgcagatttttcggatgacgtgcatttcatgggtaatgagcacgatcgtcagaccgagtctgtcatttatatcggataaaagatccaaaattgaatcggtcgtctgcggatcgagcgctgatgtcgcttcatcgcacagaaggactttcggattattggcgagcgcccgggcgatgccgacacgctgcttttgaccgccgctcagctgcgacggataagatttttctttcccctctaatccgaccagtttaatcaattcatcagcgcggcggacccgttcgctttttttcacgccggcgatttccagcgggaacataatgttctcccggacggtgcgcgaccacagaaggttaaaatgctggaagatcatgctgatttcctggcgcgcttttctcagcccgcggctgcttactttatttaattccgtccccgcgacttccacggttcccgacgtcggcttttcaaggccgttcaggagacggattaaggaacttttaccagctccgctatatcctataattccaaatatttcgccctttttgatatcaagagtgacatcttggacagcattgacatccccatgcttcgctttgtaaatttttgaaacattttgaagatggatcaaagcaatcacccgccttacactattctaagaaatcttccgggtttctccgcaaaagaaaagcctttctgcaaaaatgagcagaaaggcttattgaaaaaggcctttctctcatctttcaaagcagaccgcttcgagtgaattggcaccatttcaacattgttgatggttgccgggcttcatagggcacttccctccacctctcttgataagagaaaacatatcgtattttcgtccggaaattcttactgtagaatagcacggcgaatgataaaaagtcaataaaataaatattggaagctattgtcacatagtagattggcagttacggccgtttactgatcgcctgaaaaaatccgtttgtcagccagaggatggcctccagcttcagcagggctctgaatgatcctttcactttgagttttccgctttggataagcttttgcaaagagacatcaccatgcaggagatggatgatttccgtctggtttccgtaaaaggtcaaattagatttttcctttgaagccgacgtttttctcatttctccctgtccgttaattgagaccgttaaggcttctgtttctccttggaatgtaatcagcagcgttgaggcgtttaatagcggtttcaaaaacagatgctgtccgtcattctctgaaacttctattttctccactcgtataacctcccgttttaatggccatacatacactttctctttttaacggacagaaccctttataaaccgcacgacattttcctgtaaatattgtcacatcgggaacgtttgcgatgttttttgtttaatcagctcatataaataggaaacggagcggaaggcgtatcctttctcaacaagctctccgcctttaaacagcaaaaagcacggaacgctttcaatctgataggctttggcgaatgcgggggaataattcacgttgtttttatagaaggcggcgccgggcagcatttcttcgacgacagtaagcattttggacgccagctggcatgtgccgcaaaacggggtgtacaaatacaggagataaacgtcatcctgaatcgattcgagttcattttcttggagttctttcatgattaccacctcaggtcgttctttttcaaaaatacagtgtcagcatcaaatccggctctgatcagcacagatgcgagatgatggcccgggcacgactcgacttgcctgtatgttctgtctatataaatatggcgcgcttcgggaagctcccgtttcagctgttttcttagtttatctcccgagtcatctgcgtccgttaaaatatagacgtctctgtcaaacaggcggtccgccaaatcttccagttcggtttggccgattgtcccgtttgtacagacgatttccgcgggttcgatgagcacttccctgactttgattttatcagattttccttctacgataatgaccttttcatctccgttgtacataagcgcgtcacctgccgattgttttagcgtcagattgaaaaagaaggcagtgaaattcaccgccaactgttaacaccagccattctcataatcgcaatcgacatatttcggatcgctgccgtttatgacatcggctgttttataaaatttttgattttcaaatgaaaagccctgtttgagctcgtactggtccatgcctgtcatctcgccgatggcttcattttcatgaaacaaggaaaaccggccgttttgaaagcggcccgtgacgttctccgtcacatcgaccttttgtttatcaaaagccattttagacacctcccgttacagatagagtgtccaaatggcccctttgctatccgatcagtcttcctgtgtcatttcgtcatattgctcagaagtcatgaggttttcgatttcttcagcatcagccggttccacgacgatcatccacgctttttcatacggagactcgtttacgaattccggactgtcatcaaggtcttcgttcacttccgtcaccgttccgttaatcggtgcgtacagttcggatacggttttgacggattccacgctgccgaatggctcgtccgctttaatttcggcgccgacttccggaagctcgacaaatacgatgtcgccaagttcagcttgcgcgaaatgtgtaatcccgatacgggcttttccgtcctcaactttgacccattcgtgctctttggaataacgcatatctttcggtgtgctcatctaaatccctccatttttttcttataataagaagataccataattctttgaacctggcattacatccaatatttttcgaattggtcttctttaaagccgacagtgactttttcgccgtctgtcgtaatcgggcgtttcaggagcataccgtctgatgccaggagttcaagctgttcatcctctgacatatgatacagtttttcctttaagttcagctcgcggtatttcattccgctcgtgttgaaaaactttttgagctcaagaccgctcttttcatagaggtctttaatttcttctttcgacggagtttcctccgcgatatgtatttcgtttatttccttaccacggttttccagccattttttcgcattacggcacgttccgcatttagggtaccagtaaaaatttatcgacatcttcttcaccccttgtaaatgatcgtcgttattttaacacaatcacttgtaaaaacctataacgttgcttcatgaaaaagcgcccctgatgaaggagcgctttcagcatgtgatcagactgtatatttttcttcacggaagacggctgctgccgcttcacgttttttctgaatgaggtttttcggcgtcaggcgcgtcagtttgcgcagcacggaaagcatcatgcggagggaatctccttcctccatggcgatcagtgattctttggcgtgcgcttcaatgttctgaagggcttcctgggcaaagatttccgtatataacagcttctgcgcggctttttcggcaccgtccgccgcaattgctttttccgttctgaggacggcagattccaaagcatacagcgcgctgacaatatcggcaatgttcaccatgatttcctgctcgccttcaatctctttgccgtatttctgcgccgcgaggcccgctgtcaagagggcgatttttttcgcctgtctgacaatgtatttttcctgttcaagaggttctgagcccggctcttcaggcatcagcatcatgagttcatcttggagcgcttttgctttttcaaagagcggcagctgaccttttacggcttttttcagaaacgtgctcgttacgatcaggcggttgatttcatttgtgccttcaaaaatcctgttgattcttgagtcgcgataggcgcgctccacttcatattcctgcataaacccgtaaccgccgtgaatttgaacgccttcgtcggcaatgtaatcaagcgtttcagaaccgcacattttgttgagcgagcattcaatcgcgtactcggcgatggacttcgcgacttcgcgtccgtctttttgctcctcttccgtcagtctgctcatattatcttcgaataagcctactgttctgtatacagagctctccatggcgtaaagccgggctgacatcgtcgcaagcttttcctgagtgagcgtgaagcttgagatcggcgttttaaattgccggcgctggtttgcataagcggcagacagctcaatcacccgttttgaagcgccgattgtgccgacggcaagcttgtagcgcccgatattcagaatattaaaggcgatgacatggccttttccgatttcgccgagaagattttctttcgggacttccgcctgatctaaaatcagcgttcttgtcgatgaacccttaatccccatttttttctcttccggtcccgttgatacgcccggatagttcttttctacgataaatgcggaaaatttatctccgtccactttagcgtagacgacaaagacatctgcaaaggcggagtttgtaatccattgcttttccccgttaagaatatagtgtgtgcccgcttcattcaaaacagccgtcgttttcgcgccgagggcatctgaacctgaaccgggctcagttaaggcgtatgccgcgattctttgtcctgaagccaagtccggcaaataggtttttttctgttcttccgttccgaagaacacgatcggcaatgagccgataccgacgtgagcgccgtaagatagcgaaaagctgccggcacgtgaaaacttttccgtaatgaaggctgaactgattttatccaggccgattccgccatactcttcaggcacgtctgctccgaggaggccgagatccccggcttttttcagcagtctgaccgaatgctcaaactgatggttttcaatttcatctatataaggaagcacatcgtttacgacatagtcttctgtcgttttgccgatcattttatgttcgtctgtaaagtcctccggagtgaatatttgatcatatcccgtctcttcaatcagaaagctgccgccttttttgacgttgaccgtttcctgtttcatgttcgtttccccctttgtttaaatgagttcaaatacgccggcagcgcccatgccgcctccgatgcacatcgtcaccacgccgaattgctcgtttctccgtttcatttcatgaatgagtgacagggtcagcttcgtccccgtgcatccgagcggatgtccgagcgcgatggcgcctccgttgacgttcaccttttcttcatctatcccgagcgacctgatgacttgaatggcctgtgaagcaaaggcctcattcaattcaaaaagcccgatatcctgtaattcgagtccggcaagcttgagcgcccgcggaatggcttcaatcggaccgatccccattacctcagggggaacgccgcctacggcaaaggaacggaatttgactagcggcgccaatccgagcgacgaagctttttcgcgatccatcagcatgacagccgccgcgccgtcacttgtttgtgaagagttcccggccgtcacggttcccgttttagaaaaagccgggcggagcttcgccaagacgtcagccgatgtgccggggcgcacgccttcatcctgagaaaacgtaaattgttttttccgcggcttatggtcatccccgacttctgtcagcgatacttcaaccggcacgatttcgtcattgaatttcccttccttaagggcttttgcggcattctgatggctgcggactgcaaatgcatcctgatcttctctggataccccgtacgtttcggcgacttgctccgctgtgtgccccatgctcatgtaatactcaggcgcatgctccgccaaagcgatattcggccgtgtcacatgccccatcatcggaacttgcgacatggattccgcaccgcccgcaatgacggtgtcacccgcgccgatcataattttttccgcaccgtaagcgatggactggagtccggaagagcagtagcggttcaccgtaatggccggcaccgtatgaggaagccccgccagcgcaccgatattccgcgccatatttaatccttgttcggcttcaggtgttgcacatccgataattaagtcatcgatatttccttcatagccgcctgcccgtttcagcgtttcttttacacaaagcgcgcctaaatcatcaggacgaacggctgcaagcgatccttttttcgctttaccgaccggggttctcgcaccggccacaatgactgcttctctcataaacaccctcctagttccgtaaaggtttgcctttgacgagcatatgctgcattctcgcttgagatttcgcctcgccagcgaggcttaaaaaggcttctctttcaatctcgagtaaatattcttctgaaacctccgtgccgaacgggactcttccgccggcaatgacatgggccagcttcttcgcaatcttcatatcgtgatcggataaataacccgaccgtctcatttggtctgctccgagcagtaatgccgcacagccggtttctccggtgactttcacttttttgcgggcaggcggacggtatccgctgtcatataaggaagcagccagctgtttcgcatcgtgcagcaggtgatcctgattcatgctgatacggtctgccgcggacaaaatcttcatgtcacgggcttcgtgtgccgaaccggacaccttggcaagcgcgattgtttcgaaggttttaatcgctgcgtccatgagttcacttccgccgtccaaataattcatgtacagctctttgtttcctccgccgcccggaataaggccgacgccggtttcaacgagacccatatacgattcgctcgccgcctgaacgcgtgccgccgggagacagacttccgtgccgccgccgagtgtcatcccgaatggcgccgctacaacgggtttagcgctgtatttgatgttcagcatcgtctgctgaaaacggcggatgacaaaatcgacttccatgaagttatcatcctgggcttccattaaaatcatcgcaaggtttgctcccgcgcagaaatgtctgccttggttaccgatgacaagacctttataattccgctccgtttcctcaagcgcattgtcaatcatctgaataatgtctaagccgatcgcgttgcttttcgtatgaaattccagcagcgcgacatcatcgccgagatcaatcagacttgcgccgctgtttttagtgataacgccttttgtttcttttaacgtctgcaggctgatccgtttcggattttctttcacagccctgtattggccgtctgaataataaaattgtgttccgttttccttcatataaaatgtttcatggccctgatcaagcatctctttcacccagccggggagtgctgcgccttcttcttcgagccgctccgctgattttctgacgccgatggcatcccacatctcaaacggtccgagctcccatccgaagccccatttcatggcgtcatcaattgctttgatatcatcagcgatctcacctaaaagccgggctgagtataagagtgtttgcgatgtgatattccaaagcaggcgtccggcgcggtcatcggaatatacaagcgctttcattttgcctttggcaccctttgcctgtttggcggcttctaaagcgggcgtcttcattttcgagcgctcaccgtatgtcatggtcagcggatcgagttcatatattgttttaccttcttttttgtaaaatccttggcctgatttgctgcccagccaattgtttttcagcatgtcattcataaattcaggaagcttaaacatgtctttttcagcgccgtcggctttatcatacacattttttgccacatgagcgaaagtatcaagccccacaacgtcaagggttctgaaggtcgcgcttttcggtctgccgatcaaaggcccggtcaccgtgtccacctcgccgatgcggcagccggaagaaagcatttctcttaccgtgaccagcaggccgtacgtaccgatgcggttggcgataaagttaggcgtgtcttttgcgatgacgacacctttcccaagcgtgttttctgcaaatgaagtcataaactccagcacgtcaggatctgtttcctgaatcggaatgatttccagaagcttcaagtagcgggccggattaaagaaatgggttcctaagaaatgagctttaaaatcggcagatcggccttccgccatttttgtgacggagataccggacgtattgctcgacacgatgcttcccggtttccggtattcatcaacgagtgagaaaatctgtttttttacgtcaagattttcgacgacgacttcaataatccaatcagcatccttcaattgagctgcgtcatcttccaaattccccgccgttatatagtcgagattggcagccgaagtcagcggcgccggtttttgcttcagcagcttttgcatggccgatcggctcagtctgctgcggacctccgggctttctaatgtcagcccttttttcatctcatcctttgtcagctcgtttggcacaatatcaagcagcaggacgggaattccgatgttagccaagtgcgcggcaattccggatcccatgacgcctgatccgagaacggctgctttctttataaacttgtgcatgagtcatcccccttgaactttgaatgaatagtcattcattttttcggcaaaaaaaatgaaacccttttcttctttcatcttaaaagattttcaggatgacttcaatagcaaatatggaatttttttaaatttttcggcttccgcatgttccatggcgcgggcgggaaacttaaacccggaggtgaagggaatggtgcgagggagaaaagatccgtcttctgccgcagtgagcgcggccagcatgaaaggaaatgcgggaccgaagcaaaaatacggcggcggcaaacggacgagccaaaatcagcaatataaaaaagacaacatggaataacatactgcggctgctttttggagcagccgttattttttgaagatccctttcagcacaaacgccgcatttgccgggcgctcggcaattcttctcatcaagtacccgtaccaatcggttccgtacgggacatacaccctcatcctgtatccttcttcggcaagctccttctggcgctccgttctgatgccgtacagcatttggaattcaaactgctcccgtggaatctgatgctcgctgatgagtgttttcgtataagaaatgatgtcatcatcatgtgttgccaccgccgtttcatggccgctcaaaagctgcagcttaatcagctgctgaaaatgaagatcggttgcttttttatcagggaacgcaacggccgccggttctttataagcgccttttacaagcctgagccgcggcttatatggcatcagaccgctgatgtcttcagctgcgcggtacaaataagcctgaatgacggtgccgagcatcggaaaatccggcttgcaccgcttatacagctcaagcgtacggccgcatcttgaatagtcctccatatcaatcgttacaggcacgccgcgttcttttgcctccgtcaatatgtctctgacatgctgttccgcgagttcctcggaaatatccagaccgatggatgttaatttcagcgacagctcacaatccagttgattctcggcaatcgccctgattgcttttttacattcttccgccgtccttttcgcatccttctctgaacccgcatattcacctagataatcaatcgaagccgacagccctttttggttcagccgctttaccgttttcacagcttccgtgagcgtttcccctgcaacgaaccttcccgcaccgaagcggattccgtaagcctgggcgaattttgtaagcattttatttttcgacaaaaataaacatatgctccgcagcaaggatgaactccctcctttttcttttattcgtgtatgaatttccggtcgcagagaaagctaaaacacaaaagccatgcagattgccaagatatcagttcatatatccatacagactctgatgtcaaagcaatgtattatattatcaagatattcaaacggttttaatgagtcacaaaaaggatcaataaaaatcactactccttcaattgagtttccgagctataattccgcttcttcgttacatttcgcccaaaaaaacttttaatttatatttctttatccccttataatttgaaaatattccttaaaagataattgatttataatttacaatggcttatatttaaaattgataattcagtttattgaacgtatctattaagaaggaaaagcagaatttcaaaatgataattctgctgaatttatctttgcctcacaaacatacctccaaagcattattatttctttctaatagctttacgatccttcatcttaaagatggcttctcttccctaacggaatttaaagaagggacctgtctgagttatccattcaccttattttgaagaatcactaagctcgaaacatatgaaaagagggaaccttcaagtggattcaacaggaaaatctaaacgtacacttttattaattggacttattatagctatgtttttttctgctctggacgggacaatcgtaggaacggttatgcctaagattgtaggagatctcggcggcctgagcatgatgacttggctgactacggcctacctattaacatctacctccatcgttccgatcgctggaaaacttgcagatctattagggcgccgggcagtatatgtggccgggctgattatattcatgattggctcttcactgtgcggcctggctgataacatgaaagaattaattgtgtttcgaggtttacaaggtcttggcggaggcattatgatgccgatggctatgattgtcattggagatttattcacaggcaaacagcgtgccagatttcaaggcgtatttggcggtatttacgctcttgcttctgtaatcggtccgcaaattgggggatggattgtagattctttcagctggcattgggtattttttatcaatttacccgtgggaatggtagctgtgttctttattgcgatgggattgcaggccagaaaatacacgggtccgattcattttgatttcatcgggatgtttacaatgattacgggtgtagtctgtttgctgcttacactcagtttcggcggaaaagaatttgactggttatcatggcagacattttgtctgttagctttggccactataagtattattagttttgtatttgcagaaaaaaaagctgcagaaccaattctgcctatacatcttctaaaaagcagaacttttatcttcctaaatttaatagggttctttatgagtattgggatgtttgcagcaatcaccttcgtccctttcttcatgcaaggaataatcggcatgagtgcatcagagtccgggacaatcatgatgccgatgatggtcgcaatgattatctccagtattataggcgggcagctggtctttaaaatcggcattaaagcgcagattatcacggggatggcaatcatatcctttgcctattttttattatccacattagaagctgacaccagcaaattaactgcaactacttatgtagctatcatcggcttcggtatgggccttgttatgcccattattactctggcacttcaagagagtttctctaaagaaacgctcggcgtggttacttcgtcaagccaatttttccgctctatcggaggtacgtttggaattacgattctgggagcagtgatgaatgccaagtcaggaaatatattaaccgataaattagttccttttttagacaatttcccaaaacaagaaaacgcattggcagctcatctcaaagacttgatcagcagcaatcctcaagtcctgctacagaggctattcagttctgattcattcgaacaatttccgcattctatagcaaagcacatcataccgataatgaagacagcgttaatggactctcttcgcagtgtatttttcgcagggcttatactattaattgccggagtattttctgcttttcttttaccaaaaataaaaataactgaaagaaaagccggcactgatctagacaataaaccggcagctgaagtccaatcctagtgccgctgctgactttcgcatatatcgaactgttaacattaacagacattatccgaaggttttttcttctgatagtgtctttttttattgtaaatattgatgtctctcctgcaaatcgtggttattttaatttatctgtatgaaatcccggtcgcagagaaagctaaaaagaacagaattgaaggaggcgtttatatgaacaaccaagagcagcacggaaacttgccgcctgccgtcatctcaacgaaagaccatttgtatcttgaggacatgctgaactggaatctgcttgccatgaaaaaagcgcattttatggcggaacactgccagaatcagacgttaaaacaagagcttgatcagatcggccggatgcatgagaagcattatcagcacatattgggccgcttgaaccccgatcaaggcggacagacaacaacaggctacatgcaataggaggacaatacatggaacagcaaaatcaaaaaatcacgaatccgcaaacgcccgtgcccaatacggcgcaaatgaatgacagagacttggtcaatgagctgctgacgacggaaaaatacatcacggcttcatattgcacagccctgcacgagttcagccacgagtctctttatcaagatattcaggcgattttcgatgagtcacaaaaagcgcaaagaagattatacgatgtgatgtttcaaaatggctggtattccattgaagcagccgatacccaaaagcttcagcaatcgtatcagaagttccggcagaccattcagcagcagtctccctaccagcagtaaaacgaagaaggatttgatgttttcgccaagcatcaatccttttttatttttgcacaaaaagattgacttatcattaatccttatttatatttaactaatgttaattattttctcgaggaacaagatgaggaggagttatgaaaaacgcggatcaatatgtgtctgacatccagaaatctcttcagacgctgctgcaaaacatacagcctgaaatggtggaaagcatggcaaaacacgaggtgacgcctgcccaattatttgttttagccagcctgaaaaaacacgggagctgcaaagtttccgaaattgcggaacgcatggaggtaaagccgagcgcggttacgctgatggccgaccgcctcgaacaaaaaggacttatcgtccgcaaacataaccagcaggacagacgcgtcatcgacatcagcctcaccaaaaaaggcgaaacaaaattcgaagatgttgtggaaggacggaaagcgatactggcgcgaaacctgtccgttctgactgacgacgaactgattcagtccgtgaacatcatccgcaaagtagcggaagccgccgagaaatacgcggctgatcaaaaagaaaacgaatagaaagaggagctgccgaaacatgagcattgaaaagaaagatccaaaacgcacattattaataacaggcttaatcatcgccatgtttttctcagcccttgacggcaccatcgtaggaacggcgattcctaaaatcgtgggtgacctcgggggattaagcatgatgacgtggctgaccacggcatatcttttaacttcgacgacgatcgttccgattgcggggaaacttgcagatttattggggcgccgcgtcgtctatgtgtcaggtttattgatttttatgggagcttccgccctgtgcggaatggccagcaacatgacggaattgatcattttccgcggacttcagggaatcggcggcggtgtcatgatgccgatggccatgatcgtcatcggggatttgttcacagggaaacagcgtgctaagttccaagggcttttcggagcgatttacggccttgcttccgttatcggcccgcaaatcgggggctggattgttgactctttaaattggaaatgggttttctatatcaacctgccagtcggaatcttagccgtgatctttatcgcaagaggacttcaaggcagaaaacagactgggccgattaactttgacatcgccggcattttcacaatgattgtcggaatcgtcagcctccttctcgcgctcagcttcggaggaaaggattacgcatggggctcttggcagattctcggtctctttgcgcttgcgcttgccgggattgtcggattcattttcgctgaaatcaaagcaaaagagccgattctgccgatgtacctgtttaaaaacagaacgtttaccgtactgaatctgatcgggtttttcatgagtatcggcatgttcggcgccgttacgttcgttcctttctttatgcagggaattatcggagtcagcgccaccgcgtccggcacgattatgacgccgatgatggtatctatgattatcacaagtattatcggaggccagctggtttataagatcggtattaaaccgcaaatcatgatcggcatgctgatcatggccgtcggcttcttcttattaacgaccttacagctggatacaagcaagctcgcggctacgtgctatatggccgtgatcggtctgggaatggggctcgtcatgccgcttctcacactcgctctgcaagaaacgttttcaaaagaagagctgggcgttgtgacttcatcaagccaatttttccggatgatcgggggaacgttcggcattacggtgctcggcgctgtcatgaatgccagatcaggaagccttttaaccgacagactggtgccttacttagactcactcccgaaacaggcaagtgcctttgccgcccagtttaaaggtatgattgacaagaatcctgaagggctgcttcaatccttgttcagtcaggaatcgattaagcagattccggccgcattttcttcccatatcgtgccggttttgaaaacgtcactgatggattcgcttcacagcgtgtttttcacaggcctggcctttatcgctgccggattgatcctcacgctgtttgttaaatcaattaagctgacaaacaaaaagacaggcaaacaagaagaaaaggcgaaagccgtttaacaaagaaaaatcccgcggatgccgcgggatttttttatatcatctgggcctctccgtttccaaatgaccagtcttccgcctcattggaaatcggggggtgaaaattatttaataaaccttaaacatttcatcgttatctttatagtacgacataataaagtcacgaaaatttcttaccgaagaagacaacagcctatgtctcatccaagataagccgactggatatgaagcagagtgatcagtcacttttataaaattcagccccaatgttctgcaaactgaaataggaagcaacgcaacacctcgatccagctttataatctcgacaagtaaatgagaatccgcctcaaatgcaatatttggggtgaaaccggctttttcacaaagcgaggctgtaaaaccgctatactcctcattattagcaagggtaataaatggttcatcggcgacaagacgtaaagaaatttcggttttacccgtaaatcggtggtttgagggcaaagccagaacaatatcttcatttaccagcacacaactctctatttcttcatcttgaatcggatgacctgttattcctaaatcaatgtcccctttctttaaacttgttatgatcccgcttttaactccgatggcttggagaatttttgattgaggggagcggttgatatattcactcatcagtcctgcaaggaatcttggattagaaatagatattcttatggtgtcagacatttgatgttcctccaattgaatctccgtttgtgcattttcaatctcagtaaaaatcctgtttacatgttttaaaagaatcttccctgatgaactcagcttaatatttctgccttttctctcaaacaaagctgttcccagttcattctcaagtctttttatagtgagacttaaagaaggctgggcaatctttaattgttctgctgctttagaaatatgctcagtataggcaactgtctgaaagtattttagctgcagcaattccatctgtctgcatcctcctcatttatttcaataaatatatatataacttattatgtattagattaaatgtaaatgcggatgtaagataatagcatagttaaagaaaaggaaagggtgtcatgcaatgaaaattgatgtgaaagatatagcaaaaaatttaaatacgccactaacggctcctgcttatcctatcccaaattataaatttgttaaccgtgaatatttaaatattatttaccgaacggatgaaaaagctttacgtgcgacagtgccagaacctcttgaaattactgaaccttttgtgaaattcgaagtgatgcggatgcccgatgtttccggacttggtgcctatacagaggcgggacaagtcatccctgtcagctttaatggtgaagaaggagattatgtacactctatgtatgtagacaatttcccggctattgcaagcggacgggaacttactgcatatccaaagaaattgggcgcccctaagctgtatatagactctgatactctcgttggcacattagattatggcagtcttcgtgtggcagctgcgactatgggatataaacatttcgaaatggacaaggaaaaagcgaaaagggaaatttgccgacctaattttatggttaagattgctactgattacaatggtgatttaagggtttgcgatttggtgcggacgcaaataacgaatatagaagttaaaggtgcctggtctggaccggcgcggcttcaattatttgaacatgctctggcgcctcttgcagatttgcctgtattagaagtcgtttcagcatctcatattattacggatttaaccttaaatgcagcacagccggtttataactacttagaggaaaaataaggagacgtttacaatgagaattgcaattttaggagcaggttctttaggaaccatagttggagcatatctgtctgctggcggaatggatgtcgaattgattgattcatacaaagaacatgtagatactttaaatcaaataggtgctaaagtagttggtacaacggcatttcaggcaaaggtaaaagccattacccctgaaaacaagtcaggcaagtatgatttcatattacttctgacgaaacaattatataatgactccattcttaaagagttactgccttttttaaaggatgacagtgtagtatgttccttgcaaaacggtatacctgaacagaaagttgcttcgatcgttggtgatgaacgtgttattgcgggttctgttgaatttggtgctacgtttattgaaccaggcgtatccagacttacaactgagtatactcaatttaaagagtacgcttttcaaattggagaattaaatggtgaaacaacagaaagaatccagcgtattaaatcggttttagaccttatcggcggaacacatatttccgataatttagttggaacgaagtggtcaaaattacttatcaataatgcgttcagtggtttatcggcagcattaaacggagaatacggagacattcttgaccatgaaatcggcattgtcagcgcagttcatatcgcagatgagacgattaaggttggacacgccaatggtgtcaaatttgcgaaaatgggcggccttgatttagaatctttggaattaagaagtgaaaatgagattcctgaacgtattcaaacatttagggcagccatggaaccatccaggcttttaagagcaagtatgcttcaggatcttgagaaaaaacgtaaaactgaaattgattatattaatggagttattcccaaaatggcagaaggtactggaatttcaacaccttttcatgatttggttgtagcacaagtcaaatgtgccgaggaatctcaaacagtgcccaattttgatacaaatataaaagcctatgaagagttattacgtatccgaaaggaaatgtgatatataggaaagagagaaagggattgctgcggcagtccttttttcttggttcagcaagtaaacaaatgggtgtgttagttacataaaagttcttcgttatgaattgaacggcgcctttattgattccttttcagcaaaaaaagcttccggcacctctctttgatgccgaaagctttttattgtttttttctgtgagcttcattgagctgtttaatgtgctgtatcgcagctttgatgccctctttggcgtccgggtaggattgattccaatgtttgacgagcggaggcatgctttttgcgatatgtgtatacaaaatccactgcctgacttcttcctttacatccgggtttgtttcgccaagcaatagttccgtgtatttctcaagcaggccgtccagctgctgctgcagtttctcttccataccgtttccttccctttttcatgattatgacaatcgggcggtgagggccgcttcctgcacgatacatctgccgcgtccgtgcggaatgcaaagcggcgtgccgaacagcggatcttgcgttacctggcagttcatcgcaaagacctgctgtacaagctcgcaagtgatgacttcttcgggacggccctctgcgtaaatctgtttatccttaatggcgaccagataatgggcataacggcatgccagattgaggtcgtgcagcaccatgacgattgtgcgtttttctttttcatttaattcaaacagcaaatcaagaatttcaatttgatgcgtcatgtcgagataagttgtcggctcgtcaagcagaatgatatccgtatcctgagcgagtgtcatcgcaatccatgcacgctggcgctgtccgcctgacaaggaatccacaggacggtcggccatttcctcaagcttcgtcgcttttagcgcttttgtgactgcgtcttcgtcctctttggaccattgcttcagccagctttgataagggtatcttccctgcttcacaagctgatgcaccgtcaggccttcgggagctgacggactctgcggcaaaatagcgagctctcttgccacttccttcgtcggaagcttagcgatcgcttttccttctaaaagaacagaaccgcccctcggtttcatcagccgggccaatgaacgtaaaagcgtcgattttccgcagccgttgcttccgatcaatacagtgatttcgccttttggaatcgcgacatccaattcgtcaatgataacagtctctccgtaccctaagctcagcgtctctgtagaaattgcactcataccgctaaccgctccttttttgagtttcccaacactatgtatataaacaaattgcctaaacattcaacgtgagatcatgattatattgtaacagaaattaatgactctgaatatcattatcaattagttttgggcaaaaaagcagcgggaggcggttatttttttatttccgtcatttctccgtcgttctttttcagtttcagataaaaatggtcatagcggctgtctaaattaaaagccgagagcacctgccggacgacctcgctttcctgcatccggccgtttacggcaagttctccgaggatcatcttcatttcatcaagcgcttcctcgccctctctgtgaacccctgagagcttgtcccggatgtccgccttttcatgaccgctttttctttcatacaaaccttcatagcggttatgctctccggctccgtagctgacgcgaagggaaaagctgctgtaaggaaccggctttgcggatgacacgggtgtgctgtcttgttccgcttcccgtttttcttcattcaatcggcagccggcaatcagcatcagcgtaagacataaaacgcccgccgttctgatccatttcatgcgattcactcccattccattccgatcgtttttaggtatttccaagggagacggctgtcattcacggaacaaaaaagaaccggagcggtaacagctccggccggttcatctccagattatcattcagtcagctctaaaaattcctgcacatcctgtacggcaaggcggaccgcgtcttcccaaaacgaccgttccgtgagatccgctccaaggtgcttcatcgccaaatcctcaacggtcatcgaagccgtgtcacacaaaagcgcgatatatttttcttcaaaatccgctttttcccgaagagctcttgcgtatattccaagcgaaaataaataaccgaacgtgtacggaaaattgtagaacggcactcccgtaatatgaaaatgcagttttgacgcccagaaatgaggatggtattcccctaatgaatcgcaaaatgcttctttctgcgccgcttccatcaattcattcaatttatcagccggaacgacgccctgcttccgctcttcataaaaacgcgtttcaaataaaaatctcgcatgaatattcataaacatggctacgcttctttgaattttatcttcaagcaagaacagcttttcatcctttgtctccgcttgtttcaaagcggcgtcggcgacgatcatttccgcaaaggtcgaggctgtttcagccacattcatggcgtaggctctgttcagctgccgcacttgaagcatggcctcctgatggaacgcgtgaccgagctcatgcgccagcgtcgatacattcgaagcgcttccggaaaacgtcataaaaatccgggattctccgctgtcgggaaagctggtgcagaaaccgccgacccgtttgccgctgcggtcttccgcttctatccaccgatcgcggaacgctttttccgtgaatgcggacagctttttgccaaacgtcgaaaattggctgacgatcagattagccgcttcatcatatgtgtattctttcggagcttcgccgatcggcgcgtccacatcataccagttcagccgctcaagccctaaaagagacgcctttcgattcaggtattcggcaaaaggctttttatgatcggtaatgacctgccacatgacatccagcgtttcttttttcatccgattgatcgcaagcggctcttccaaagcgcttttccagccccgcgctttatagatttccgttcggaagccggccagatggttcagcgtgctgctgaaaagctcctcttctcctttccaggcttcattaagctctttgaacacttgacgtctgatgcggcgatccgggtgcgccatcatattttccgcttggccgaccgacagctctttattctcaaacggaatcttcattctgccgacagccgcattatacaggtcgccccatgcgtggtagccgtcaacggccaggccttcaatcagcctttcttctgaagcgctgagcttctctctgacacggtctcttctctcatttaagacatatgtgagatcctgaagttccggtttttgcagcagctcctcccagacccgctcgtcaatccgggcaagtgtatcgtcaagggtcaccagagcggatttaaaatcactgctcagctgattaatccgcgccctccattcattcgctttctgatcatgagtgttctgagcctgaagacagccgacgaacgctcccgcctgcctgatcatgatcgctgaccgttcaaacctatcaatcagattgatcagctcccggctttcatccgcgtgcgtcggaactgtaaatgcttcaaccgcatgttgaaaagcgcttagatgctttttgagctcttgtatgtattgctgaaactcttccgaccggctcccgccctcaaaaatggagtttaaatcccatgtttccttcaatccctctaataccatcttttctttacccctttctacccgaagctgactctattataaaacaattctgacatatttccgaacgatttctccttctttccgcgagatgttatacactatgagataagaacaaacggggaggattataagatgaacagaaaagttgccattgtaaccggcgcgacgagcggattcgggatgctgacagcgctgaagctcacccggtcttatcacgtcatcgcaacagccagacagccggagaaagctgtaatactgaaagaggccgctgctcaagcgggtgcatccgaacatattacggtcgtttctttagatgtgacaaataagcagtcggtgtctgacttcgggaacaccatcagcggtttcggaccgattgacttgcttgtcaataacgccggcactgcgtacggggggtttattgaagatgtgctgatggaacattacagacagcagtatgaaacaaatgtattcggtctgattcatgtcacgaaaaccgtgctgccttatatgcgaaaacatggcggggcgaaaatcttcaatatcagcagtatcagcggactgaccggtttcccggctctatctccgtatgtctcttccaagttcgcggttgaagggtttacagagtgtctgcgccttgagcttctgcctttaggaattgatgccgctttaatagaaccgggctcctataaaacgtctatttgggagacgtctctctccagccatattacggcgcccggcaaagacacgccttattatcgcttttatcagccccttgaagcttacttcaaagccaacgcatccaaaagcggcaatcctgatgacgtagcggagctgatttatcaattggcacaaaggaaacggctgaagaaactgcggtatcccatcggcaggggcgttaagctgacattggctttccgctcactctttccgtggtccgcttgggaatcgattataaagaaaaagctgttcacttaaactaaattataataattataatttagtattgatttttatttgatacgtgatataattaaattaacagatcacagggaggacgatgaatatgaatacacaaaacgcgaaaaaaactgaaactcttgttgagaaatcaatgaacacacaattatcaaactggtttatcctttactctaagctgcaccgcttccattggtatgtaaaaggccctcacttctttacgcttcatgaaaaatttgaagaactgtataacgaagcggcggaaacggcggatgccatcgcagagcgtcttctggccatcggcggacagcctgcggcgactttgcacacttaccttgaacaagcttccattacggatgaaggtcaggaaaaaacggcttctgaaatggtggaatcactggttcaagactataaacaaatcagccgcgaatcaaaatttgtcatcggcatcgccgaggaacaaaatgacccgtcaactgccgacctgtttgtcggattagttgaagaagcggacaagcatgtgtggatgctgtcagcctacttgggagaatgacgaaaaaagctgaacctcagttgaaggttcagctttttttatgcgttcagcttgcgctttcagtttgtttcgttaatgtgacgttcagcgtctttttgcttccgcttctgagcacttgaacagtcgttttatcgccgattttcagctggttatataagatctgtctgatatcggcgctgctgtcgacatctttgccgttcaattgtacaatgacgtcatttgatttgatgcccgctttcgcagccggtgagccggattgcacttcttttacataaacacccttagacagctggtcgccgaacagtccgagcgtgttttcctgataggtttccggcacttgcgccatgtcaatcatctgcacacctaaaaatgggcgctccacttttccttttgcaagcagctggtcgactatcggttctacatcattgctcggaatggcaaagccgagtgactccacgccgttttcactgactttcatgctgttgatcccgataacctggccgcttgagttgattaacgggccgccgctgtttccggggttaatggccgcatccgtctgaatcacgttcatttccaccgtgccttgggatgtatcggcgtccaccgttctgttcagcccgctgatgacaccttgtgtaacggtgccggaaaactgctggccgagcgggttgccgatggcaatcactttatcggcaatgcggagcttggaggaatccccgaagctagcggcttttttgacattggacgagctgatttccaatacagccaagtcactgatggcatcctttccgacaagctttgccgtttcggttttcccattgtaaagagtgaccgacagtttgttcgccccttctacgacatgattgtttgtaatgatgtacgctttttcgccgtcttttttgaagatgacgcctgaccccgtgccgctttccgtttcagagcttgaaccgccgtcaagtccgaactggctgctttgcgaagcttggtagttggacactccgacaatcgcaggctccaactcttctaccatatccgctacgcttgaggtatttttcaacggcgttgacgtaaaattcgaagactggacttgtttcgtatcagaaacggcttctgtcttatgctgctcacccggcaggttcggcacaatgccaagcacgaggcctccgccgataatgccgcctaaaatcgggctcagccaagcggctctccgttttttttcttttttcacggcagccgttttttcaaattccgtaccggcagccgtctcgttttccggttctttcgagacggtcccttcaagcagctcgggctcctgatggctgatctgctgctgttcatttctgttttgttccgtatgtgaaagatctgactgatcgcggcttctgccgtcatctcgatgatcgttcatattcgcgcacactccttcagcatgttttcattctatcgattacatattcatcgcatgtacaagttctattgtcccaataataaggagaaaagcaaagctccaaaacaaaatgtgtttgaacatgttatcttccccgctttttttcttcctttcttcccttatacacatcataaacaaacattgtgggataaaaatgaaaagaatatgtgaaattatgaaaatgcggcttgagtatgttaaaactagtataatgacgttgaaaggatgtgaaatgccttgtcatacaccatttatctagttgaagatgaggataacctgaatgaactgctcacaaaatatttagagaatgaaggctggaacattacatctttcacaaaaggcgaagatgccagaaagcagatgcagccgtctccccacttgtggattcttgacatcatgcttccggatacggacggctatacattgataaaagaaataaaagaaaaagatcccgatgtgccggtcattttcatttccgcgcgggatgccgatattgacagagtcctcgggttagagcttggaagcaatgattatatcgccaagccttttttgccgagagagcttattatacgggtccagaaactgctcgagctcgtgtataaagaacagcccgccgcaaagaaaaccggcatcaccgtttcttcctacaatgtgatcgaagatgcccgagaggtttatgatgaaaccggcagcctggtcaatttgacgtctaaggaatttgatctgctgcttttatttcttcaccataaaggacaccccttttccagagaagatatcctgctgaaaatatggggccatgattatttcggcactgaccgggtggtcgatgaccttgtgcggaggctgagaaaaaaaatgcccgggttaaaggttgagaccatttacggattcggctacaggatgatgacgtcatgaaaaataagccgcttgcttttcaaatatgggtggtcatctcaggcatcctcttagccatttcgattctgcttctcgtgctgttctcaaatacgctgcgtcattttttcacggatgaaacgtatacgaccattgaaaatgaacagcatgtactgacggagtaccggctgcctggatcgatcgagcggggatattacagcgaggatgcgaccgctccgacgactttccgatccgttcagcacgttcttctgccggaacgggaggaatcggccagtgacaaagacttgaactacttttcttcttcctttatccataaggtgtacaagctcgcgggccgccagcacagcgtcacgaaacgatacagcgcggacatcagcggtgaaaaagtatttttcgtcattaaaaaaggcctcaccattaacggccaggatgcgatgatgctgtcttacgcccttgattcttatcgtgatgatctggcattcaccctgttcaagcagcttctctttatcattgccggcgtgattttgttaagctggattccggcgatttggcttgccaaatatctctcgcgcccgctcgtttccttagagaagcatgtcaaacggatttccaaacaggactgggatgatccggtcatcgtcgacagaaaagacgaaatcggaaaattaggccataccattgaagacatgcggagcaagctggtacaaaaggatgaaacggaaagaacgctcctgcaaaatatctctcatgatttaaaaacgcctgtcatggtgataagaggctatactcaatcaataaaggacgggatttttcctaagggggatctggaaaccacaattgatgtcattgaaggcgaagcagaaaaacttgagaagaaaattaaggatttattatatttaacgaagcttgattatttaatgaagcagcgggtgcaccatgagacatttgacattgtgaaggtcacggaagaagtcattgaacggctcaaatgggcccggaaggaattattgtggagcgttgatacagaagatgcattaatgatgcccggtgatccggaacaatggagcaaacttcttgaaaacattctcgaaaatcaaatccgctatgcagaaacggcgattcacattcagatcagccaaaatcagcagcagattgtcatgacggttaaaaatgacgggcctccgattgaggatgagatgctatccagcttgtacgagccttttaataaagggaagaaaggcgagttcggcataggactcagcatcgtaaaacggattttaaccctgcataaagcatcaatttcaattgaaaatgaccaatcgggtgtaatctaccgaattatcataccaaagtagactgtagtgtttcattgcagtctttttttatgtgaaggaatagccgttaaaatctctgtagtttgctttcagcggtttttggcattgatgaacccatttcttttcacaaattgtctttttcggatatttcaccttttcgactttaattcctctgtttcgcaagcggctgatcatttcatctaattctttcattttcagattcaccctttcgccagaactttgaccattcggtcagctcactttataatataaataaaacaaaacaaaaaaacaagttacaatcaggttaaatttacggaatatcaatatgaccatatagtcatacatgagaagcacaagccagcctcctggctccgaaagggtggaaccattgaaggaaaaagaaaagctgatcattgaagcagcaatcaaactgtttgcccgaaaagggtacaaatctacatcggttcaggaaatcgccgatgaatgcaaaatctcaaaaggcgctttttatctttactttccttccaaagaagcactgctcctatccatgctgaattactactatgataaaacgtttacccgaatcacgacgatccaaacggagggtgacagtccgagagccgcttaccaaaaacagcttgcggtattttacgaatcgattctcgcccatcaggattttattaccgtgcagatgaaagacggttcacttccttataccgaagaagcggcgcagtgcggaaagagaatccgccggtcgatcctgcagtttcatatcgacagtcttcttgctatttacggagaaaaagctgaaccatacacagccgagctttgttttttaatagaaggaatcagtcagatgtatcttgagtatctgattctgaccggccggtccgtacagccttcgcttctggcaaataccgtgattcacagaattgatgacatcgtaaacggaatggcggacagacatgatgaagcgtttatttctcttgatgaggcaagctcactgtttgggccccttcataacgggcagcccgatcctttaagtcaatcgatcttgcagaccctccgcacgcgcatcggcacgatggacaaggggcaagcatctgaattcaccgagagcttggatattctggaagcggaaatgaagaaaaagtcaccgaaaccggcaatcatcaaaggaatgattttgaatttgaaggaatccgatctgctggctgaagatgcagaacagctcagatttttactgaaacagcagtttatttagaagaacggccgcaataactgcagccgttctttctttttatgctttcgggtgcaccatatcttccggacgcaccatttcattaaattgttcttctgtcagaaggttcagctgtaatgccgcttctttcagtgtcaggccttctttgtgggcaagcttggcgattttcgcggcgttttcataaccgatgtgcgggttaagcgccgtaacaagcattaatgagttagagagattttcctgaatcgtctcttggttcggctcaataccgacagcgcatttgtcatggaaggaattcattccgtcactgagcagctgcacggtctgcaggaagttataaataataaccggtttgaagacattcagctcgaagtttccttggctggccgcaaatccgattgtcgcgtcatttcccatcacttgcgcggcgatcattgtcagcgcctcactttgcgtcgggttgactttgcccggcatgatagagcttcccggctcattttcaggaatgacgatttcgccgattccgcagcgcgggccgctagccagccatctgacatcgttggcaatcttcatcaggtcggcagccaatgcttttaacgcgccgtgaacgtgagtgatttcatcatggcttgtgagcgcgtggaatttgttaggcgaacttttgaatgtctgccccgttacttttgtgatttcttccgcgacgtattcaccgaactgcggatgggcgttgattcccgtgccgactgccgtgcctccgatggcaagcgcgcggattttttccgttgactcaagaatcatttctttcgaacggtcaagcatgtatacccagccgctgatttcctgtccgagcgtcagcggagtggcgtcctgcaaatgcgtgcgtccgattttcacaatatcctgataagctttcgctttttcatcaagcgtcgcgcgcagctgatcaagcgccggaacgagctgctcatatacggcaagaaccgccgcaacgtgcatcgccgtcgggaatgtatcatttgagctttggctgcggttgacgtcatcattcggatgaatcttcagctcggaatttttttctttcaataaagcagtcgcgcggttggccaccacttcattcatgttcatgttgctttgcgtgccgcttcccgtctgccagacaacgagcggaaagttatcgtcgtgtttgccgtttaaaacatcgtcacatacagcggcaatcgcttgtgctttttcagactctaagttgccgaggcgttcgttggcgatcgctgtgcttcttttcaatattgcaaacgccttcacaacacgctgaggcattttttctgaaccgattttgaagttctccttgctgcgctgtgtctgagcgccccaaaatttatctgccggaactttaacttctcccatggtgtctttttcaattctgtagtccatttatgtatccctccataacagttgcttcaccctgagtattattcgccagtaacagatgaaaccctttttatttttcggccttggccgtttttaatttcagctcaagatagacgcgcgaatccttagaatatttatacttcggatttgttttacggtattctttcgacgtgtaagccacttcgtaatgcgcttcaaatgatttgatgagctgttcaatttcttcggcattccctgccagtctgacttgtgccacatctctcctccgctttcataaaaaaacttgtaccattaaatactttatcatagtatatcatttttttaacaggaaaagataacctcaattaaggattggaaggcgggtgactgtcgatggcgcaatcggaattcaaggaatacatacacgttaatctggcactggtgcttccccacgtagagcagaatgatgacctggttcaaaataaaaagatgcttccgaacgggcttgttttttattatatgtatctgagtgaaatgaacgacgaagacaaaataaaagaagcgattgaaacgctgcttcgtgaggaagacactctgacgctggatacggtgacgaaacgtcttgataagatcgacgcccgtcccgtctttacgtcgaaggaagccgtcatctccattctgcggggaaaatgcgccgtgtttattaacggacttgacagcgtatacattttgtccacgggaaaaagagaaaaaagaagcgtgaatgaacccacatccgaaaaggtcgtaagaggtccgaaaatcgccttcatagaagattctgatacaaacatcgccatgatcaggcagcgcacgaaccatccgaagctgaaaacgaaaaaggttccgatcggagaaaacaagttaaaatacgccacggtcatgtacatagatgataaggcggacccgtctgtcgtcagcgatgttgtaaagcgcctcagcgaagtgaagatggacgacatccaggattccggaacgcttgaggagcttattgaggataataagtattcgccctttccgcaaatacaaaatacggaacggcctgataaagtgtcttccgccttgttcaacggccgcgtcgccatccttgtcgacaactcgccgtttgcgctggtggttccggcttctttaggaattttaatgcagtctcccgatgattattatgaacggtggatttccgcctcgctcatccgggcgctcaggtttacgtctatttttattacgctgtttttttcgtccatttatatcgccctcgtttcgtttcaccaagggctgctgccgacgtcgcttgcagtcaccatcgcggcgaacagagaaaacgtccccttcccgcctatcattgaagcgatggtgatggaaattacgatcgagctgctgagggaagcgggcttgaggcttcccagcccgctcggccagacgatcggattggtgggcggagtcgtcatcggccaggcagccgttgaagcgaatattgtcagctccatcatggtcatcgtggtcagcattgtcgcgctcgcttcatttacggtgccgcagtacgggatgggtctgtcgttccgtgtgctccgttttatttcgatgtttaccgcggcagctttcgggctgtacggcatgattttatttatgctggcgatctacactcatttatcgagacagcgaagcttcggttctccgtatttctcgccgaatggatttttcagcttaaaaaacgcaaacgactctattctccgtctccctattaaaaatcaaccaaaagaggcgaaaaacataaatgagccagaaaacaactcacaataagcttacaagctatcaagggacagcattgattgcaaacacgatgctcggcgcggggcttctcaccatgccgcgggcgctgtcatccagggcaaattcgccggacggctggatcgcgttatgtctggaaggcgtcatctttatctttttgatttatctcaatacgctcattatgaaaaagcatcagtacggatcattatttgattatatgaatgaaggactcggcaaatgggcgggaaatatcgtcaatctgatgatctgtctctattttataggagtcgccagcttcgaagcccgggcgatggcggaaatggtcaagttctttttattggaaagaacgcccgtgccggtcacgctgtttatctttatcgcctgttccgtttatttaattatcggcggcatgagcgatatcggcaggctctttcctttctatttaacgattacgatcattattttgctggtggtgttttccttcagctttaaaatatttgatatcgacaacctgcggccggtgctcggacaggggttttctcccgttatggcctccttgaccgtcgtttctgtttcctttttggggattgagattatgctgtttctccccgagtacctcaaaaataaaaagcacacgttcggcatgtcggccatgggctttggcatcccgattattttatacattattacctacgtgctcgtcgtcggcgccttaaccacccaggatgtcaaaacaatgatctggcctacgatcgcgctctttcaatcatttgaaatcaaagggctttttattgaaaggttcgagtcctttttgcttgttgtctggattatccaatttttcgccacctatgtatcatacggatatttcgcgacatcaggccttcataaaattttcgggctgaagcagaaaaagggcgtcatcttcgtcgggattgcgacattcttggggtcattgatgccaaaggatgcgaacaagctgatgctgttcagtgatattctcggctatatcttcttggttttctttttgctgcctttactgatatttgcagtcgtcgctgtgaaaaggaaggtgaaaaaagcgcaatgaagaaatacatcgtaatcatattttgcacattgcttttggccgggtgctgggacagccgcaatttagaagacttgagcctcgttatcggagtcgggctcgataaacccgcggaagaaaatgtggaagtgacacagcagattctggttccgcaaaaagcaagtgcccagcagtcgtcgtcaggtgacacgacaaaggtgacttccactccaggggaaaccgtccatcaagcattacgaacggcatcgttaaaaaatcaccccgccttctcccagcacttgcgtatcatgctgttttccgaagcgctgttaaaggatcacatcccgcttgacgcattgatgaaccaatttatcagggacaacggtacaagaagaagctgcaatgtgatgacggtgccggataaaacgaaagatattttcaatatcagtgatcagggagagcctgcgtcaaatacgatctatgacttaacggagaacaatgcggtcaccatccggatgatggagcccgtgacattgggggaaatatcagagaaaatcgccaaaggcgagacctttgcccttcctcaagtgcgcaaagtgggcagcagactggaaatctggggcgctaccattattaaaaataaattctggtatgcgaatttaacgcctttacaagtccagaatatgaacctgttcacaggcacggtaaagggaggcgtcacgtttgcaaagcatgacaattattatttatccttcgaggtattttccagcaaatatgatgtgaaaacacaatataaaaacggaaaattcaagtttatcgtcacccggtttgttgaaggccgtctgtctgaggattggaacccgaaagaagattctttcaaggagtcctatataaatgaaatcaaaaacgcggtaaaacaccgcattcattcagatgttatggcattcattgattacatgcagcatgacttgaaagtggatattaccgggttaggcgatcaagtccggattcattatcccgataaatggaaaaagatatcctctgactgggatcatcatttcagtgaatcggatattgaatataaagtcaaagtcgccatcagggatttcggaacaaagggaatgtcccaatgaccccgtccctcgggagagtgtgccggcgccgctctccttttcttatgtcacgagatgattgcggtgggcatatacggctgcctgcgtgcggtcactgacatcaagctttgacaatatattcgtaatgtgggttttcactgttttaatcgtaatgaagagctcttcaccaatctctttattcgtcttgccttccgcgacgagacagaggatttccagttctcttttcgtcagcgtttcatgcggaagctgattctctgaatggcgcagccttgacagcacttttcccgccactttcgattcaagcttcggttcacccttggcagccgctctgatggcttcggctatttctgccgccttggacgttttcagcaaatagctgagcgctcccgcttcgatcaccggatacactttgtcgtcatcaataaagctcgtcagcacgatgattttcgggtcattgagtttcgcgcagatctgttttgtcgcttcgatgccgtccatgccgtccatgacaaggtccattaaaatcacatccggcaaaagctctgcggccagatcgacgccctgctgcccgtctgatgcttcaccggcgacttcaatgtccggctgtgcttctaaaaatgcggccagacccatcctgaccatctcatgatcatcaatcagtaacactcgaatcactgtcgttctctccttttgttttctgataaatcgggactttcacgtcgatctgcgtgccttttccctttacggagataatttccgctatgccgccgatttcactcgctctttccttgatggaatgcaggccgtatgaggatgctttcacttgatccatcgtaaaacccgccccgttatcaatgactttaagctgcagcttttgatgtttcgcgccgagtctgacggtgaccttggtcgcctttgaatgtctgaaaacgttggaaagcgcctcctgcacgatgcggaacagatggtcttcaacgccttttgacacacccgtatcgctgatgtcccactcaatatccagcggctgcttcgctttgaactcttttaacagctcaatcagcccttcttttaagccttttccttctaaagtgacgggccgcagatgcaatagcagcgctctcatctcgttttgcgcttcccccgccatatgttcaaccatgcgaatccgtttgacgattttgtcatccgcatctttcacctgctctaagacggcggatgtcatcatagaaatggcaaagagctgctggctgacggcatcgtgcagatcgcgcgccagccgctggcgttcttcagtgatgaccgattttttcatttgatcctgccattccgcccgctcgttggagagcttttgcagcgatgtgacttggagctcgacccgcttggccatttcgttgagctgatctgccgccagaccgatttcatcatcgccgagcggcggcacccgataagcaaaattgccgttttcaaatttcaaaaccgcttcaatcagtgtatccattcttgttttcaggcggcctccgtatacataaccggaaatcaatccggccgaaagtgacgccagaagcaggatgaccacaaacggaataccgaaccagccggaagaaaacagcagcatcgggtcaagcccgtaatacagcagcatcagcgtaataaacaccgcgcaaaggagcagactgagccccgcggtcatccgcatggcgcgccactgaatattggcgagtaattttttcctcataaatacttcacatccacatcgccgatgaataacgaaattgaaattttaatccgccgcggcgagtcgccgtactcagacgatactttataaagattcgggctcatgccgcttttcttagagccgagcaggttcatatcgccgataaaagccgatgaactgacggacacttcgatatccggcgggacgtacacatcgacattgccgatgacaccgctgatggtcatcgtgctttctccttcgggaatcatcgcttttgacaaatcaattttcacatcgccgatgaatccggaaacatttaaatcattcagctcaaatgggtccttcatcatccgcagctcgccgataaaaaagctgcggagatccggctgtctgctttccgtctgggcggaaggctttggctgctcttctttttcaagattgattttcttctctttatgttcatacacgcgctttcctttcaggagcctgtagcccgcgtatatgagaaaggcggcgaaggcatagccgaacaggttaaaggtggcgctgaacaggttcctcaaaaataaaaaagcggcgaagatatacaggacggagccgagccagccgcgggaatatttattaaaaatatagcctgtaatcagaaaaaagagcggccaaaacaagaagtcgccgatgccgataatacgcaaaaacatgctgacgcctaataaggcgatgataagtccgagaatctgtttttttgccatcagctgcctgcccctcctttccttgactattgcagtgcaatattgccgctcgtcacttttatatcaatcggcctggcgccgctgcccttcataccggtgaatgccccgccgtccttactcgttttctcaaaggaataagacggctgaatccttccgcttgccgtctcggcgttcaccgtaaaacttccgtctttcggcaggctgatcgctgcgctgccgctcgcaagcctgacggatacgggagcatccgccgtctcaagcgaggcgtcgacactgccggaagcgacccgcacgtcaagggcgcccgccgcatgttgaagcccgacatgtccggaggataagcggatatcccccgttttcgccgcaaggcctgatgctgtgaggttgcccgacagccccttcgcttcaaacacatccgtcttcacgtgcttcagcgacatattcccgcttacagaacggacgccgaggtacgcaagagacagccccttgtttccgtcaacggcaatggtgccgcttgacgtatggacggtgatgtcccgatgataatcatacggaatgcggacaatcagcagaggacgctgaaagagattcagaaattggaaccctttctccttcgctttgagattgagggtttttcccctgctttggacaaacattttccccgccggtcccgccatgtttgccgcgatatcattccgcgcttccgcgatgatttttacatccgtctgttccgatgaaaccgacaggctgttgacggcacgcggcggtatgcttgccgattccgcttctgtttcgtacagcggaaaaaaacgcccggcaaacacttctttcaccaaaaacagacagcagatcagaacggacgccgccatcagtcctttggccatcttacgcttcattacgttccatcctttttcattcattttattataaaggaaaagccggagaattgatacgtgcgtatagggaagaggcgtaaaagcgccgatcttcccttgtgcacattattcatgagccgctttttgatgctctgttttctccagagaaagcgagcgcattttttcgatctcggcttccacctcatctgaatattgggagcggctgtattctgtgttcgcctcagctgaagtgccgtatttgacgcggacttccatttcttcaatgcggctttccattcgaaggaactctctataggcgctttcactgtcaattttgtcgaaagaagcgttcatatgttccttcgcttttgccgcgttggcacgggcgatgagcgcctgttttttatcctttacgtcgcggaggcgcgtttctaaagtttccagctgctctttcagctctgccagctgtgttttcgcctgttcatacgctttttcatgttcggccgcttttccctcaaggtatttcatttcagtcagcgcctttttcgcaagctcctcttccccggcatcaaaagcaagctgagcctgatttttccgttttgccgccgtttcggaggcgtcttcctgttttttcttaaactgatggacgatcgtgtgctgtttgacaattgtttgtttcgccttagcgatgtcactttccatatcacgcacatattgattcagcatgactttcggattttctaatttatcaagcccttcgttaacagatgcgacgaacatatttcttattctttttaagaccattttgtcttcctccttattttttcttcagaaattcttcccattcagagtcaaatccggattgatagcccggtgacgccgcttccggttcatactggcgggaagcggtgtctgagccgccctgcttcatcatcttccacccgaaatacaccatggcgccggccagtccgatggcaacgataaatggaagagaaccgacgagaatcatagctccgatgaagcccgcgatgatacccgataccgcccggccttttgaaaaacgtttgattccccagtaaagcatcaggcctccgatcgccagcgggatgataaatgcgaaatggcctcctccgaaaaagacagaaagtccgaacacaatcagcagaaagccgcctgccgtttttacatttatattcatgcagatcctcctttcgttttccttgtctttactataaacaaatcccgcggccggcaaaacgagtcagagattgattttcatatcagaccggagtcgtataaccccccggaccttcgcataaaaaaacgccgctgcaccggacggcgcagggcgtttcacgaaaaatctatattctgatgctcgcttctttttccctgatgagatctgagcgttcagctttggccagcttcgtaaagatcaatattccgagaccggacaggacttcaacgagaccgccggcggcaatgacttttccgggaccgaaggcattagccgcgtatccgcaaagaaccgcgccgagcggaatggatatgtttgagatcatgtggatgacggcatagacttgcggctggtcatcatggtccacagacgtctgaataatcgtatattccggcacattaatcgcgctgacggcagatccgaacgcaaacgcggcgaggaagacgagcggcagaaaagtgttgaggccggtgatgaaaaatgccgccccttctatgattcccgctgacacaaacaggagaccgtatttgttcaccttcaccttagccaaaataaaacccattaaaaaggctccgcccgtgcctgtcgctttcaaaagcgagtagatgatcggcggcatgtttaaatcttcggcgacataaacggcagagagcgcctcccacggagcggccgcaaaattcatgaagatacaatagatggcgagcgggtataaaatctggtgtttcctgacaagaacgaaaccccgtttgagccttccgaaatacgtcccacgctgtctgacggcgacggcatcctctttggcatgctggacttggtatgacataaagagtacgagaaaacctgatagaagatagaatataagagcgataaacaaagaataagcgggactgataaatgttaagaacaccccgctcagcgtaatggcggcaagtctgacgatctggcctgatgactggatgaccgcattcgctttctgcaggctgttttctccgacaatattggggattaatgagatagatgcaggattataagcggctcccgtggctgaatgcaaaatcatgagaagcatgacaaaccataaaggagaaaaaccgttaaagtaacagaccggaatgatcaacacgaccgccgcgcgcgtgagatcggagaaatacatccagaatttcagcgtatgctgcttcataaaaggcccggtaatcggcgccagcatcgcctccggaaggaacgtgaccgcaatgagcagggacgtgccgatcgcgccttccccgtcaaaaatcaaaaaccacataatggaattaaaggcaaaaccgtcgcccgacaatttaacaagcctcgagataaacagaagggtgaaatttttattccagatgctctcgctcttattatatgtatccatctatcaaatcccccattattttacaatgtttcttataatatctcattttttaatttttcagtcaataatgcataagatacattttccttctgtcaataaaggttcaattgatggatatctctataaaaaacagccggcttgctgctgccggctgaacaaaacgttattcatcatcacggaataccgcggcgcttctttcatactctatatcctgaacgccctgtcttgcgttaactgctcttgccgccgcgaaaaaataatcagacaggcggttcaagtaacgcatcactgtatcgtttatctcttctgttttgcccagtttcacgacgagacgctcagcccgtcttgtgacggtccgcgcgatatgaagctgagcagccgccttatgcccgcccggaagaataaatttctcaagcgggggcgcttcagccgtgtaacggtctatgcagtcttccaatacggaaatagatgtctctcttaatgtatagtttctatgttcagtgaccgtcgccaagtcgccgccgcagtcaaacagctcatgctgaatgtttcggagttcggctttcacatcaccgcaattctcacaatcatctagctccgcaagcgcaagcccgataaagctgttcagctcatcgatcgtcccgtagctttcaacccgcagactgtctttatccgttctgccgccgatcaggcttgtctgtccttgatcgccggttttcgtatacagcttcatcgttgtattcctccttcttccgccgcttttacacatgccgcggttcctcttctgacggctctttccgcgtgagggacgtccattgtctctcctgtctgcaaggcacaaatgacaatgtcgccttttgcctgtctgccggaaagggcctgcattctcgcttcagccgctgccgttaacagccgaacaaatccctgttccgataaacgtccgctgatcagcacccaaacggtatactgcgcagtcacggctatcgtaaccgaatcaaacgtacggcagatcaaaccagctgccgctgagccggaaagccggcggctccacgaaaagcccgggccgtcagatgcggttgacagcattctgaaaggccgttctgtatgaagcgttacggtatttccgcttttgtttatcagagaggcgaacggaacgcaggcgggctctctttcctcccgcgcttccggcatgaaagcgatcagcggtttcggcgacgattgcagggcaacagcgctgacggtgatgccgtaaatgtcttcaatcgtctcttttttcaaagcctgatccggcggctgcttcggaaaagcgcgtccgtttttcatcatcaggagctgatcacaatattggcttgcggcgttgaggtcgtgaaaaatactgatgaccgtcaggcctctttctctcgtcagccgcttcaccgtatcaagcaggtctttttgatatttgagatcaagaaaagtcgtcggctcatccagacagagcacctcaggctgctgagccagcgcctgcgccagatagacgcgctgccgctcccctccgctcagattgcggacggattgctgcgcatatcggtcgatgcccgtcatttccattgcttcccggacaatgtcttcgtcatgttgatccatctgtctgaagagtcctttttgatacgggtatctgccgaaggacactgtttccttaacggtaaatgtaaaagcttgctccgtatgctgcggcaaaacggccataattttcgcaagctcacgcggcttgtatctgcccgcgggcctgcctgcgacgagcacctcgccctttgagggagagagcattcccgtcagcaatttcatcagcgttgtttttcccgagccgttcggaccgagtatgccgacaaattcaccttttccggcggtaaaactgacatcttctacaatcatccggcctccgtacccgccggacaggctgctcactctgatcataagcggttccctccatgatgctggcgaagcagaatcaaggcaaaaacaggcgatcccgccaaggccgtcataatgccgatcggcaattcgacaggctcaatgacggtgcgggaaaacaaatccgccaaaatgagaaatccggcgcccgtcaatgctgacagcggcagtaaatggcgatgatccgtcccccacaaaagccgagtcacatggggaatgacaaggccgacaaacccgatcgtccccgagacggcaaccgcgcctcccgtcagcagagatccggcggcgatcatcagcagttttctttttcccgtactgacgcctaacagccttgccttttcttctccataagtcataatgtttaattctctgccattgataagcagaagcgccgtcccggccagaaaaaaaggcagaaacagcgcgacatagccccagcccctcattgacacgcttcccaacagccagcggacaatcgggagcagatcatttcccgttaaagcaatcacaagcgaaatgagagccccgagaaaagaattcataatgatgcctgtcaaaatgagcgtcgaaaccgacatcgacgtatgaacgaggcggctgaaaaacagaaccgccgccataaccgcaatggcagcggcgatgctgacaaccggaagtgtgaaccggccgatgacgggaatctgaatgccgaaaaacaaggtgataacagctcccgccgaggctcccgaagataccccgagtgtataaggatcggcgagcggatttttcagaagtccctgaaacgccgcccccgcaatggataacgcggctccgaccagagcggccagaacgactctcggcaggcggatattgatcataatatttacattcatgggatcaacagaggatgtccggccgatcccgatccaaaaaacgtcggataaaggaatatgcagactgccgattgaaatgccgagtgccgtacaaacggctaaaaacagcaggctgaccgtgtaggccagcgggcggttactttttaaacgtttcaggataaacgctttctgcaagcttctcgacccctttgacaaggcgcgggcctgagcgtgtgacaaggtcaggatcaacagaatagacattgtggtgtttgaccgcattgacggcaccccagccggcgcgtttttccacttcagcggcctttacgccgtctgtcgtaatgatgacgtccggattcattttgacaatcgcttcatccgtcagctgcacccagccggtctggctgccggcggcgtttttcgcatgtatatcttcaagcatttcgttcataaacgtgcctttccccgtcgtgtagccgtcaggagacacttcgacgaatactttcttttcgtctttttcagaaatggcagccgctttcttttctatgccggaaaggtcggatttcatcgattggatcagctgatccgcctgcttttctttgccggccgcttttccgatcatgctgattgatttgtacacatcttggaacgattgcgcatcattgaccgttaagacggtgatgcccgcatctttcagctgcttcatcgcatcggcggaagcggacatagaggacgcgtgggcaagcacgagatccggcttcagcgcgatgactttttcagcgttcacattcatatctccgactttcggtttttttacggcttctttcggatatgtatcatttgtcgtgacgcctgcgaccttatctcccagtccgagcgcgtatgtaatttccgtattgctcggcatgagggaaacgattttttccggtgcctgctttatggttactttttcgttcgcggcatccttaatggttaccgggaatgcttcggttgagacggctttttgtttggccgcgcttccttctccctgtgcgccggaacagccggcgatcacaaaggcggtgaccaagagcgccgcccagacggcagtgatcttcttcattcttttaactccccctgattatggtaaacgattgtctctttgacattcgtatccttttttcgcagtaattatactataagtctttaaggcttgtatatccgccctttttgcatgaaagcaaattgttcgtacacactaaaattcatcatgtatactgttacacaatggtgtaaaaaggaggattatcatggaattacagcttgaacgaaagctcgtgttgattacaggatcaacttcagggatcggaaaagccgcggcaaaaagctttttagccgaaggcgccgaggtgattgtaaacggaagaaaaaaagaaaccgtggaacggacggttgaggagctttccgcttacggaacggttcacggcatcgctgcggatttatcgcgtcaggatgaggcggatgacttgatcaagcgcgccggcggaatcggggaagtcgatgttctcgtcaataatctcggtttttttgaagtaaaggacttcgctgaggtgtctgatgatgaatggactcggtattttgaagtgaatgttatgagcgccgtgcgcctgtgccggcgttttctgccgcaaatgcttgaaagaaacagcggacggattttgaacatttccagtgaagccggagtcaaaccgcttgcgcaaatgattccgtattcaatgacgaaaacggcgttaatcagcttgtcccggggaatggcggaaatgacgaaaggcacaaatgtcacggtcaactccgtgctgccgggaccgacatggaccgaaggcgtcgcttcttacatggaaggagccgcaaaggctgccggagaagacacggacagcttcgtccgggattattttaaagtgaatgaaccgacatctttgattcagcgctatgcaaccccggaagaagtcgccaatacgattgtatttctcgcttcatcagctgcttctgccattaacggcaccgcacagcgggttgaaggcggcatcatccgctccatttaacacaaaaaagcccggcacaatgggaacttccccatatgccagggcttttttttacatcatgcctgcaaacggaaccggctcccagccgcccgtctcaagctctgctgaaaacaggccgcccgcatgcggctgctcaagtctttcggcttccgtcaatttttccgtcgcggtcgtaatgtataacgtgttcaaatctctgcctccgaacgcgcagcaggtgacgtatttcgccggaacttcgatagatgcaatttccttatgcaaaaacgggtcaatccggacggcacggccgcctccgaacagagccacccacagcattccgtcacggtcaatggtcattccgtcgggagatccttgcgactccggaaagcggtagaccgttttcggatctgatacggctccggtttcaggataatatgcataacaaacgatttcctgcgtcggagtatcaatatagtacatcaggtttcggtcccgatcccaatccaaaccgttcgaggtagagacctggtcttttattttggcaaggctgccgtccgtattcagacggtacagcgaagcctcctcttctttgccttccatgctcgtcgttcccgcccataatctgccggacgggtcgcattttgcgtcattgaaacggatatcttcccgcatgtctttcggctgcttcatcttcgtcaatgtgtcttcccgcagattgtacaggtaaaacccgtctttcatcgtcatcaccagctcttcttttgaatacaaggccagagccgtgacaaatgatttgaatttaacggaacggttgattccgtcagccggagtgaagatatggagctggctgcccagtatatccacccagtacaggcattccttatccttatcccataaagggccttctccgataactgctctcgtatctgctcgtaatgctgcttccatgtgtgaacacctcttttgcttgtcagtcttctattgttattcccgacaaagcggcgtccaaactcaatcttttttaaaaagaatcgtaatcaccgttccggcgctgattctgctgttgacatggatggttccgttatgaaggtgaaccagctctttggcaatggcgagcccgagtccagttccttctgacggccccttcgtattcgttccccggtaataacggttaaacagctggtgaatcgtttcatcgtccattcctcttccgttatctttcaccttcagaatgagctgttcggctgattcttcaagcacgacccgaatggcggtccctttcttattatgcttaaccgcgtttgccagcagattctccagaatacggcggaaccacgcttcatcaatggcgaaaagaatgtcttcctttttggtttcaaaggcgatgtcatagccttccgagaacgtgtttttcgtgaaatcgttcgtgacgtttctgataaacggcacgacgttgatcagccgccgttcgatcgggagggccgcgtttttgaggcggtatgttaagtttaagtcctcaatcagcttcgacatatattctgatttttcccggacgatctgccccatttctttgacttcttccggtgtccagtcgtattgcttcgattcaagcatcatgctgtagccgtaaatcgtgctcagcggggtttttaagtcatggctcagcccggcgatccattcttcccttgtcgcctggattttttctctgtttttcttatcccgcttcagcgtgtcggtcagctgatccatcgattcgaaaatctcggcgaaaaagcggaacggctgttttgttttgccttttttgtttttgctgaccggctgtcctttgcggttcttcggctcttcaagccggccctttgataaattgacaagccatttgatggtatgaaacagcggccagccgaaacggaaagagtaccaaatggtcaggatgcagatcataaataccaggattccgatcaagaggaagagggttttcatcacatttctcaaaaatgatttgttaaactcgtgatcggggatgtacacggggttcggcaccgacgcgaccatccatttcgttttatcgagtcttttaaaagaaatttcccgtttgtaattccacggcttggaactgtatttcagcaattcaagctcattgacggtgttccgttcttttttcgtgctgttgatatccccgagcagtctgccgctgtcttcgagaaggtagaccgcccctttttcccgtttaatataatcaaccgtgctttttttatattgagaaagggaagcgagggatggctcctgtgattcgatgtaagtgagaagctgctcactggcggatttccagccgaacagaatcaaataggtctcatcatttatcgtgaccgtccagtaattcagcttgtagttgtcaaaattccggtactggtaaatggataagaggtcttttctgctgtaatggctcgggacgtctttcggcactctgtacgcgtagtccgttttttctttgtcattaatgatctgcagccagcccttctgctttctgaccgacatctttaaaaattcatcgacatcccatgtgccgtcttcgtttttatcaagccacgcttcaaacgagtctgccgtcgctttggtcagtcccgcattggcttccgcttcgctgaaacgccaatccaaatagaagaaagaagcgacggccaaaacggacatcagcaggatgacaagcagaagctgtccgaaaaagtggagcagaaattttccgcgcattctcatgagcgggttcctttttctccttgatcgggaataaaccgatagccgaggccgcgcaccgttacaatataagacggattgctggggtctttttcaatcttttctctgagcttgcggatatgcaccatgacggtgttgttatcgccgtaagacggatatccccacactttttcatagatctgatcttttgagagcaccacatcagggtgttcacagaaatattgaagcaattgcagaagctgtgcggagcagctgacgggctcgcccccgacgatcagctcggcgttttgcggcgaataggaaaaatggctgtatgaatacgtttttaccgccgctttctcttcgcgcttataggttctctttaacgtcgctctgatccgcgccgccaattcgagcggattaaacggctttgttatataatcgtcagctcccaatgcaaatcctgacagcttatccgcatcagaagaacgggcagtcagaaaaaagatcggagcgtcggtatagttccggatttcggtgcatgcttcaaaaccggacatgccttccatcatcacatccagcacgagcagatccgcggattcatgtttaacaaactcaatcgcttcctcagcgcttccggctgtcttaatgttgtgatagccttctttgacgagaacgcgtttgaccatatcaacgatcgccttctcatcgtctacaattaaaattgacgcattttccaccttggacgttcctttctctttgtttttttcatcatatcattatatggataagatttggtacttttttagtgcggaggtcttgcggggaaacagaaaagaaaaacgagaccggacatctcttctcgtttttctcacgttgtcagagcagaatatccatcattccgccgcttttgtcaggagctttcatttataagatgaagaataaattcccaaaaacccggcacttcctggcataacagcatgtccgctttttcaactattttaatcttcaattcttgttcaaggtcttctctttcctggtatgatgtattgctcagttttttttttatcattggcgaaaaacgcgaaatcaaaagttccatttcgtcggtatctgtgttctctttgttgaagtcaaatggcccgttcactgcttattttccccctttttttgcttgtccagctgctttctgagattgtcgagcccttttttatgaatattggaaatgttctgccgtgattcacccagcgactcggcaatctctttcatcgtcgctccgtgaagataaatattcgtcagcacgcttttttgtttatcggttaacgtctgaagcgcttcgtataaatcacggttttggacatgctggctcaaatctccctgcttccgcagaaactcttcatacgcgtcttttcccatttcatagggaagcgcttcacctccctccggctgatccaccgtcagcggatagcgcttctgatttttacggatgcgcttgtcaaaatcgatggagaaaatccggatcatagagttcatatatttgatgatccggatttccttataaaactgtttaaaatgatcgtccagtgattttgcatccttctcgtctgaatgttccagcacatttttaaatttctcgtaatgctttgggtcacttaaaaaatgtttaacgatcggatgtttcataatttccttgcattttgaccgtaaaagaacttgatagtccataaaaccgccccctatttaaattaaatgaaagaaagcaaaaaaaagtaaactactcctttccgactaagattccgcattccttatgtcccggatttgccggaacaaaaaaaagaccctcaaccgggatatcaggtttacaggagccgttctttctttcacttatatacatgactgcaggtcaagtcaggaggtggctggtgatggatcaggtttttatagaagaagcggtcagacagatcggcaatctcggctttccggctctgattgccatgtatcttctcacacggtttgagaagaagtttgacgccctgatcgaactgatgacggaactgaaagagcagaaaatgaaaaattaattttcacacgaagttgacttttcatcggaacgcatcacttaacaaagcagaagggaaaacgaaaggcctttcacattctctttctgaaaaaacaaagcttgagaggagacgatttacatgttaaaagaaaacaactgcaatatcccgcagccgatcagaggagacaaaggggcgaccgtcacgattccgcgcaatcttgaaagagaccgccaaaatccggatatgctgacgccgccggaaacggatcacggcacagtggataatatgaaattctctttctcagatgtgcataatcggctggaaaagggcgggtacgcgcgtgaggtgaccgttcgcgagctgccgatttctgaaaatctggcatctgtcaacatgcgtttaaaaccgggcgccatccgtgaactgcactggcataaagaagccgaatgggcatatatgctgacgggcaaagcgcgggtcacgatcgttgatgaacagggacgcagttttatcgatgacgtgaaggaaggagatctgtggtacttcccgtcaggcctgccgcactccattcaggcgctgaaagaaggctgtgaattcctcttggtgtttgatgacggttccttctcagaaaacagcacattccaagtgactgactggcttgcccacacgccgcttgatgtcatcgccaacaacttcggggtttcagaaaaagacctcgccggcctgcccgggaaagaaaaatatatctttgaagagccggttcccgggaagctgaaagatgacattgtggaaggcccgaacggcgaagtgccttatccgttcacttaccgcctgctggatgaaggtccgactgctgagacggacggcggcaaagtatatatcgcggattccacaaacttcaaagtgtccaaaacgatcgcttcagcgcttgtcgtggtcgaaccgggcgcaatgagagagctgcactggcatccgaatacgcatgaatggcagtattatatttccggtaaagggcggatgacggtttttgcatcggacggccatgcaagaacatttaactatcaggccggggatgtcggttacgttccgttcgcaatgggccactatgtggagaatttgggggatgagccgctcgtcttcctggaaatcttcaaggatgaccactatgccgatgtgtccctgaaccaatggcttgccatgcttcctgagaaattcgtccagcagcatctggatctgggcaaagactttacggatattctttcgaaagagaaacaccctgtcgtcaaaaagaaatgctgaagacacacaccgacttgcagagttccgtctctgcaagtctcctctgtgtgaaaaggagctgaacagatgatcaatcaaaacgggacgaaaatgttatttcttcaggtgctccggtatgccctggcagccgctgccgtattattcgggtatttcatcgtgatgatggccgtattttcattagccgggacgagctacggatcgatggcgtacgtcctgcttttttccgtgctttttattcttctcggtttatgttttgaaccgcttgaacggctgatgatacatagctttaccttttttgggacgggcaggctgccttttctccttttagccagcaccgttcagctgctgttcctctggatgaccgcgtatacgacggataaactgattgaaaagatttggctgtcaacgacggaggagctgattgtggcgggggtttttttcgttttggataaatgcgtctccggacaaaagcagacccgggcgcaataaaaaaacgcaggccggaatggctctgcgttttttttcatcttaccgttgcgttttcatgccggattaaatcgtaggttaagcagaccggtttgttcgtgcgcggatcttttacaatctgcgcgtcaatttgaaacacgtcttccaatatgccgggagtcatgacttcctccgccgttccttccttgatgatgcgcccttttttcaaggcgatcatgtaatgggaaaaacgggcggcatggttcagatcgtgaatgaccattaaaatggtgcggccctgctccttgtttaatttgtccagcagctgcaaaatttcaagctgatgggcgagatctaaataagtggtcggttcatcaagaagcagcagctccgtttcttgagcgagcgccatggcgatccacacacgctgccgctggcccccggaaagcgcttcgatcggccggtcgtaaaattcggccatccccgtctcttcaagcgcccatttgatcatgtcacggtctttatcactcaagcggcccattccggactgatgcggaaacctgccgtaagaaacaagttcgtacaccgtcagcccgctcggcgcttcaggcgtctgcggaagaattgccatttccttggcgatgtccttcgtggatttttgcatgatcgcctgtccgtttaaatagacggcgccggatttcggtttcatgattcttgacatcgttttgagaaccgtcgattttccgcagccgttcggaccgatcagcgttgtaatttttcctttcgggatggcgatatccaattctttcgctatcaaacggtcgccataaccgacagtaagctgttccgccgataatgagttcatcgcggcagtctccttcctctatttcgttttcatcagcaaatatacaaaatacggcgctccgagcacggaaatcaccaggccgacgggaacttcggacggtgcaagcacatttctcgccagcgtatcggcaagcagaaataaaaatgctccgatcaaagctgaaaccgggataagcgtctggtggcgcggcccggtaagccttctggccaaatgcggcgcaatgagtccgagaaaagcgattccgccggctgccgcaacacatgacgcggtcagggcaacggcggacatcagcagaacgcgccgctccttttcaacccgggtgccaagccccgccgccagctgatcaccgagctggagcacatttaaatacctggctttatagaggctgaacggtaaaagaaccagcagccacggcaaaatggacagcaccattttccaattggcgttccaaatcgaaccggaaatccatacaagcgcctgcatgaaatcccgcgggtccattttcagctgaaaaatcaagagaagcgcattaaaccccgcattgacgccgattccgaccaaaacgagccggacaggtgaaacgccttttttccaagccagcacatagatgagcagcgcagccagaaaagctcccgccaaagcgctcactggaagcagccatgtactggccatgcttagatcaacagctgacccttggaaaaagaagataaacagaacgaccgccaaagacgccccggcgttaatgccgagaatgcccggctccgccaagtcattttgagacacgctttgaaaaatcgcgcctgaaaccgcgattcctgcgccgacaagcaatgacagcaccatacgcggcagtctgaattcaaataaaacgagctgatcccgggcatccccctgtccgaaaaagacacgcatcgtatcaagtggcgcaatccggatcacacccatgtttaagctgataaaaaagacgatgcatatgagcacaaacgtaacggccatgaccgccagcggttttttcgattttacattcattacagccctctcctttccctgcgcgccaaataaaagaaaaagggaacgccgataagggcggttaaagcgccgaccggtgtttcaaacggcgcattgacgagtcttgcggcaatatcactgaagactaacagaacggcgccgaataccgccgaacaaggaatgatccacctgtaatctaccccgactaaaaatcgggtgatatgcggaatcaccaagccgataaaagaaatggctccggcgactgagactgaagcccccgtcaagaggacaacgacaaacattccgattactttcacaagcgatgtgtactgcccgagccctttggccagttcctcacccaagctcagcaccgtcactgagcgcgcaatcagaaatgccagcaatagtccgataacaccggccgccaacagcagctgcacgccttcccatttcacggaagcaactcctccggcataccagaacttcacatcctgggcgacatcaaaacggatcgcaatcgcgcttgaaagccccgttaagaaatagccgactgccgtaccggccagcgcgagcttcaccggtgtcagcccgccttttgaaaacaggccgatgccaaacacaataagcgctccgattcccgctcccgcaaaggaccacaaaacaagtcccgccgcagacagacccggaaaaaaagcaaatgccaatgcgatcgcaaatcctgaccccgacgtcacgcccataatggaaggctcagcaagcgggttccgcgtcagcccctgcataatcgccccggacacagctaaaaaagccccgacgagcgcggcggcggcggttctcggcagcctcagatcgcgtatgatttgatgagatgtattttgcggctgaaagtgaaagagagcatcccacaccgtccgcagatgaatatcggcagctccgatggaaacagacagagcggcgccgatcaataaaaccgcaataccggcacacagcagcacagccgctctgaatgaacgcgccgtccactggatttcactccctgatgccccttgagccgtcattgtctgtttctttttcaatagacccaacactcgttcttcctttctcaaaacaagaatggtaatgataatgattatcaatgacttgtttcagtatagcacttttatcttctcttttaatagacctaatttcatataaaaaaagaaagtttttcttaaaaaagagcgtgcttctctatgaaagcagtgatataatcacactgataatgattctctttatcactaatttttatgaaagaaggaatgtcagatgttccatacatacaagaaaatcggcgcagcgctgattgccatgctgctcatcaccgctttggccgcatgcggcaattcttcagacacgaaaggttcttctgaaaaagaagaaaccatcacgtataaagccgaaaacggccatattaaaattccgaagcacccgaaacgggtcgtcgtcatggctgacggctactacggcgacttcaaacagctcggcatcaatgttgtcggcgcgccgcaaaacgtatttaaaaacccttattacaaagggaaaacaaaaggtgtcacaaacatcggcgacggcacgtccgttgaaaaaatcattgacttaaagccggatttaatcgttgtctggacgacacaaggcgccgacattgaaaaactggaaaaaatcgcgccgaccatcgccattaaatatgacaagctcagcaacattgatcaattcaaagagtttgcgaaaatgacaggcactgaagataaagcagacaaatggctggctgaatgggataaaaaaaccactgccgctaaaacaaaggttcaaaaagcggtcggctcaaaaaccatctccatcatgcagacaaacggaaaagacatctatgtattcggtaaagacttcggccgcggcggaagcattatttatgacaaactcgggctgaaggccacaaaactgacgcaggaaaaagccattaatcaagggccgggctacgccagcatttcactcgagaaactgcctgactttgcgggagactacatctttatggggccatggcaggccggcggtgacgagaaaggcgtgcttgacagctcaatctggaagaacctcgatgccgtcaaacaaaaccatgtctaccgcattgatccgatcggcttctatttctcagacccgatctcacttgaaggccagctcgactacatcacaaaaagcttaacgaagtaaccccgaagccgctgtcacagcggctttttattacgcttaaaacttgacaaaaaatttatttatgctataatttacatttttggattaacatgtataataagattctcccggccggagattgatgtaaataacggaggatctttatatgaaagaaaacaaggcgagtatgacttccctgctgtccgctttcggaagggcgtaccatagtaaatacgacaccccggtgatatttgatgattttttggcacaagatctgatttctgaaaaagagcattcggacatccgcgatcatctcattcaaggtatatcatttttcagtaaagacatggcacagaggcttcaaggccaaccggatgacatcttaaaatgggtgactcaagtacagctgtctcctacaccgttagcccgtgccgcatattgtgaagaagtgcttttgaatgaagtgaagctcggggccaaacagtatgtcatccttggcgcgggactggatactttctgtttcagacatcctgaggtgacaaacgccttagacatatttgaaatcgatcatcccgcttcacaggaagacaaaataaacagattgaaacatctgaatctcgacatttcccatcatcttcattttgtaccgatggacttcgccgcttcgctttctttcagccgtctgtatcaggaaggtttttcacgccaaaaaacctttttcagcctgctcggtgtgtcatactaccttacgaaagagcatctcgcccgcctgctcacacaattatttgccgaagtcccgccaggaagctctatcgtgtttgattatgcagatgagtcgctctttgaagaaagaggactgtcaaacagagtggaaaacatggtgaaaatggctgcagcaagcggggaaccgatgttatcgtgtttcagttataaagaaatcgaaaagatattagaatcatcaggtctgcttatttatgaacatttatctccggcggacgtcaatgaccgttttttcagcggacgcactgaccatttaaccgcattcgagaccattcattatatacacgccgtcaaaaagtaatccgctgccgcaaacaaaaaaagacatctcactgacgtgagatgtctttttgtcataccgattgtctgttgtttgcaaatttctttgagacgaaaggatataacagcaaaccgacgaaaaacagcccgataccgagaataaaggtcgttaaatcggccgttccggtaataatgacgtaaaaagaataaatgcaggcaaggatggcgatgataccgtctcttactcttgagccctttatctcgtcatacgtttcacccgtaaaaatgagcttcaggctgtaaaacgctgacacgagatacggaatcagataagcaagcgtcgccgccgttgttaaaaacgtaaacgcgtcactgatcgtccgggaaataaccgaaaagataaagatctgtgacatcacgttcgttacgattaacgacacaaccgggcttccctgtttattcgtttttgcaaaagcagcgggaaagtctcctgatttcgccgcttgatacggaacttcagaaccgagaagaatccagccgagcatcgttccgaacagacacaaaatcgccagaatcgccataatgacgcttcccgcgctgccgacgatcgcgtacaatacgtcaacaaacggtttttccgagccgacaagcttaccatgcggaagcacgcccatcgtaatcaatgtcacgatgatatagatgctgagcgcgatcaataatccggtaatggtggcgcgtttcacgtcgcgctgcgaacgggcgcgcccggataaaatgactgccgattcaattccgacgaacgcccataatgttgaaatcgccgcattgtggatctgtccgccgattccctcaaccgtgtgaggacctgtttgaacaggaaaataaaaatgatcgaaaaacgacgtttgaaatacaaacaaacctgcaatgataaagaagataaatcctaatacttttgaaaacgtcgtgacgaaatttaatttactcgcaccgttaatgctggtgacgaggatcgtgtgagtgccccataataaaaccgtacatacggcaaacgtcagcagctggccgagcgtaaccgcctgaccgccgatcgaaaacatttcacgcttatccgttaaaatcgggaaaaatgatgttaaatatccggcaaggctcgtgatgatcgccacgttgctgatccagctcgccacccagtagccccacaccatcgtgaagcccgctgcattcccttttttccgatcgctgaacagcgcacgcgcatagctttgcggccccgccgtcagctcaggcttgcggatggataagtggccgaagaccagcgcgatcattaacacaccggctcccgttaaaagccatgccgatgtggcgccgaacgggctcgcgatttttgcgagcgtactcggaagcgaaaagatgcccgagcctaccatatttcctacgacaaacgccgttaataaccaaaaaccccattttttcgtctgttccattcctgtacctcctggttgttcattcgtacggaccagaccccgagaccatatttacacgcaaaaaaaagcctgaacaaaagtccatgcttaaagaaacacacacacccttgatctccggatagccctccgcgaaaaagcacgcggcagtcctgcacttattcagatacagtcccagcataaagaaggatcggctttctttacacttcggcgctgatgcctttaacacatgttttgcggccccttatcagcctggcatgtgcgactcatcatcaagcgcaacctctacctcaccgagaaagagtgaggatttttatcattcaattctactcagaggttatcagagataaaaagatctgtcaaagggaaatattagacggaaaacggatagagcgttcgccctacccgtcttatatggtcagcggttgttttttttcttttgaacagcttcttgaagcggatcgtctttcagagctgcactggcgtcgtcaagcgcgccttgaatgacgtttttgtttttatcgctgttttttcctttttctttgttaaagaaagccatctgtatcacctctttatcaaatataggtacacctataatgtgtctttttccgcggcagaatatgcggaatccgcgtctccttccttttggcggaacaggtaaagtttgttgatcaaacatgcattctcttgatatatttgtaattcaggggattttggcaaaaataaaaaggagaagcgaaaaatgacaggaaaaacacacatcatgggaggcatcgcttcttgttccgcaattgcgtattattacgggtatgatccggtccttatgacctcagcgggtgccctcggggcgctgattcccgacatatgccatacgaaaagtaaaatcggcaggacgctgcccgttctgtccaaaatcgtaagcacggtgttcggccacagaacgtttacacacagcctgctgtttatgcttattatgtttttcattacggcaacctatattccgaatccgagcatttccgccggactgatgatcggaatggcgagccaccttgtacttgacgcatggaccgtcaacggcattaaactgctgtttccgtccgccatccgcttccgtcttcccctttatatgagaacggggagcttttcggagcagcttgtgctggccggcttaacgattgtatcctgctattatttatacgaactggttcacggccgcatctcttaaacaaaaagcgtcttttcgcttttagggtgaggagtcatacatatgaagaaaacctttttcagcaatcatcggtttttatgcctgtccatcctgttcatgtggatgaaaacctatgccgtgtataagctcggtttcggtctgcagaacaattcggttcttgaggaatgtctgcttctcattaatccgctgagcttcattgtgccgctgttcggcatcgccctcttgctaacggaaaaaaaacagcggatctttctgctttcggcaaatgtgatgctgacgggaattttaatcgcgaatacggtgttttacgggttttatattgattttatcaccataccggttttgtttcaggcaagcaatatgggtgatatgggaagcagcgtccaagagctgtttcacccgctttacatcgctttatttttggatattgcggttttgttttatcttggtaaaaggcataaagccgatcaaggaaaagcgggcgcccgtaccgttaaagcgtatgcgtgggcatcagccggcctcatgctgtgcaaccttgcgctgtctgaggccgagcagccgaagctgttcaagcacccttttgatcgtgaagcgctcgtaaaaggaatcggcctgttccactttcatttgtatgacaccatttcgcagacactgaatgcaggggctaaagcgtttgccgatgaagacagccttgcggcggtcgcgaattacactcaagccggctacagcaggccgtccgattcaaaattcgggcttgcaaaggggcgcaatgtgatttttgttacgctcgaatcaacacagcgttttgtaatggatgagcgggtcaacggacgggagattaccccgtttttaaacaaactgcgaaaaaaaagttatgacttcactcatttttatcagcagactgaacagggaaaaacctcagattcagaattcattactgcgaattcgctgtatccgtcttcaagcggcgccgttttttttacaaaaagcggccaccggttcaatacgatgtaccatatgttaaaagatcatcaatactattcagccgttctgcatgccaatcataaagccttttggaaccgggatgagatgtacggggcattcggaatcgaccgttttttcgacgcggatgaatttaaggtgacacaggaaaattcaacaggctggggcctgaaagataaggagtttctcgaacagtcagcggaaaaattaaagaagcttccgcagccgttttacgcaagcctgctgactttgaccaaccattttccttttgaaattgatcaacaggatcagctcattgaggaaccggacacaagcagcgagttattaaaccgctatgtgacgacggtccgctatgaagatgaggctctgaaacactttttcaagaagctgaaaaaagaagggctgtatgacaacgcgatgatcgtcctgatgggagatcattacggtatatccgaagcccataatcaaggacttgccgaattcttagggaaagaggaaatcactccgtttgatacggttcagcttcagcgcgtgccgtttatcattcatattcccggggtgaccgaccgtgcgccggaaacgattgcttcggccgcgggacaggttgatgtaaggccgacgctgcttcacctgctcggcattgaaacgaaaggcagcattcagttcggcaatgatctgttttccggagagcggacaccgtttgcggtgctgagaaacggcagctttatcacggatgaccatatttatacgaaaaatacgtgttacagccgcaaaaccggtgaaccgctttctgacatgagcgcgtgcagcgatgagaaagaaaaagcggaacaagagctgatgctttccgataaaatattaaacggcgacctgctgcggttttataagcaataaaaaaatccctccgttatatggagggatttttcatgtttcatatatgagccgtcctgtcattttcgtatcatatccggataattgagaaagctgagacttgaattcctcagaattaagaatgtcccgcacgctttgaacaagctcccggttttgttttaacacaaccacatcgtactgctcactgatcaccgggataaagtccgtgcctgccatatgcgccgcatgctgcgacccgactccgatatccgcctttccgcttgatacttgtgaagccgctgacagatgatccgtgacaatgtcatgatatccggcgacatcagacggcgtgatgccgaatgatctgagctgttcatccagcagcaccctcgcgcctgatcctttttcacgattgacgatgcggacatcctttttgctcatgtcctgaaagccctgaatgttcagcggattgccctttttcacatataatccggcctgacgaagcacgacatgaaaaagcgcaaacggctcacctgaaagaatgcgcttcacatacgggatgttatactgccccgtctccccatcgtataaatgcagactgacgatgtcacaggccccgcggtacatctcgatcaggctgttcaaactgccgctgtacttgcggagcggagccgcctgtattgtttgttccagctgtttgctgaggaggtccatcgacacatcctgcccgctgatgataacggactgccttttttccggctcccgcccgcgtgacgggccaggcgcttctgctgcggatggcttttttgacattctcatgtttgctttatattgttttaagtcctcttcatcgaccctcatctgtcttccgaccctgtacgccggaatgagtcctttttttatcaaatcatatactgtcagtttggagaccttcaaaaggcccgcaacttcttctattgtataggaagtggcttctgtcatattatcacgctccgtttttattataactgttcagatattgaaaaaaaaccgcaccatcacgtacaattgcgttataattagtttgatctaatgatatttagctataaggggtgcacaatgttgaaaaagaaagcgacactactcacaactgcggctatggccgttttcctcgcaactgcgggctgctcatccggacaatcgtccaaaggcggacaaaacgaaaaagtcacgctgaccgtttctgcagcagccagcgctcaggatgcacttgaagaaatccagaccaactacgaaaaatcacattcaaacgtaaccattcaagacaacttcggatcatcaggcacattgcaaaaacaaatttcacaaggcgcgggagctgatttattcttctcggcagccgaagataaattcgaaaagctcgttcatgacggagatatcgacaaaaaggacagcacggatcttttgaaaaatgatctcgtcatgatcgtgcctgagaaaaacagcgcacacctgacacatctgaatgacctgaaaaaagacagcacggaaaaaatcgcgctcggcacgcctgaatccgttccggccggacaatacgccaaacagtcactgacggcattatccctgtgggacaaggtaaaagataaagtcgtctatgcaaaagacgtccgccaggtgctttcttatgttgaaaccggaaatgtcgatgccgggcttgtctataaaacagacgcactgatttcgaaaaaggtgaaaatcaccgatgaagcaccggcgaaaacgcacgatccgatcgtgtatcctgtcggcatcgtcaaggatacaaagcaccgtaaagaagcagaagcgttttatcagtatctgcagtcagatgaagcgatgaaagtgtttaagaaatatggatttactgccaagtaacattacggcttcggagtttttcactcccgtcgtactgtcatttgaggtggctttggcatcgggcatcgccgtcatcattctcgggacgcttgccggcgcctggatggcgaaagcgcgatttcccggaaaaacggctgtggagactctgtttatgctcccgctcgttctcccgcctaccgttgtcggcttcattctcattatcattttcgggaaacacagctttatcggccgggcgattgagcggatttttcaccagcccgtcattttcacgtggtcggccgcggtgatcgcttcggccattgtcgccttcccgcttatgtatcagtccgctaaaaccggcttcgccgcgattgatgctgacatcgagggagcggcgaaagtagacggagccggcaggtggcaggtgttcacccgtatttccgtcccgcttgcctttccctccctcttgaccggaagcattctcagtattgcaagggcgctaggtgaattcggggcgactttaatgtttgcgggaaatattcccggcgtcacccaaacgctgccgacagcaatttacgtcgcgatggactccggcaatgaaacactcgcctgggtgtgggtgatctgtattgtgatcatttcttttctgatgctgtttttcatccaattgaaaaaacccgcttgaccgttccgccttccgcgcacctttcgccgggaggctttttgatttaaaatcggatggtatataatgaaacaaaaacacacaaagggtgcggctatgaagattaatgtcattatcgcggatgataattctttcatcagagaaggaatgaaaatcattttgcatacatatgaggaatttactgtatcggcaacgttggaaaacggactcgaggcggcagagtattgtaaacacaaccccgtcgatatcgccttgctggacgtccgcatgccggtgatgaacggcgtcgaagccgcaaaacggatcgctgaggaaacggatacgaagccgatgatcctgacgacatttgacgacgatgagtatattttagaagcaattaaaaacggcgcgaaaggatatttattaaaaaacaccgaaccggaacggatccgcgatgcgatcaaaagcgttttcaacgggcacagcattcttcaggacaccgtgctggacaaaataaaagacagccttttccggccggcggaagccgcgcatcagattaatgaaagccagtttactgaaagagagctcagcatcatgtcgcttattgcgaaaggactgtcgaacagggaaatttcaaaacagcttttcatttctgaagggacgacggccaattatatttcatctattttagggaaaacggggcttgagcacagaacgcagatcgccattttttatatcaccgggaaggtggataacgggcgttgaacggtatggatttttggatgctgatgagcagactgatcgccattttttatacggcttttttgttcgtatcggcagaccgcccttacacgccgtacgccgtcttgtttctgctgctttatctgtctttgggcatcgcggtctgcatgatcaggccgcccgtttggaggcgcgggatcaccctcatggcgctggcattgaccgcttggctttccgccttaggccatccggcgtttctgtttcttttgccgcccgccatttttgccgttcttgccgaatatccggttcaccgctatgtgttctgcctgctcgtgtttttgccgtttttatttatcccgtacggcgaccttccgacttatatcgtcatgaccttgttctgtctggcgattttcgttttggccgcccgatccggcaatcggctgaagaaatatgaagaacagtcggacatcatgcgctcaagcattgaaaaactgacaaaacagctgcacagcagcacagaatatatcaaacaatcggagtacaccggcaaactcgaggaaagaaacagattatcccaagccatccatgataaaatcggccattccatgaccggcgcgctcattcagatggaagcggcgaagcggatgctcggctcccatccggacaaagcggctgaactgctccaaaacgccattaccatttccaaagagggcatagaggatatccgcataacgctgaaaaatatgaaaccgcccgctgaacaaatgggcattcacagattaagaacgtttattgatgaattttcggccaaaaacgggatgccggttccgtttacgcatcaaggcgatttggacaggctgacgcaaatgcattggagagtcattcaggaaaacgtaaccgaagccttgaccaatgcgatgaaatacgccgatgccacgcagattttcattgatatccatgtgctgaataaagccgtgaaagcggaagtgaaagataacggaaacggcgctgtccgctttaaaaaaggcctcggcatgctcggtatggaagaacgggcggccgtcctgcacggaaccgttatttttgacggcacggccggtttttccgttacgacattgcttccggttgaataagtgaatgttttcatgtgaaaaatatgaagattctcatgtcaaaggaatgaacagctgcactaacggccgttcattcttttttttataataagagcatcataagacatagaggtggaaacatgaacattttggagctcaaacagctgagtaagaaattcggtgattatgccgccgttgaccagatgtcgcttgccgtaaaagaaggtgagattttcgggtttctcggcgcaaacggagccggaaaaagcacgacgatcaatatgatctcaggtcttttaaaaccttcaggcggagacattctgtttctcggaaaagatattttcaaatatagcaaagcaacgaaaatgaatatcggcatcgtccctcaggacctcgcgatttacgaagaattaaacgcctatgaaaatgtgaagttcttcgcaggtctgtacggcctgagaggggcggctctgaaagaacgggtcgaggaagccctgacattcgtcggcttgagcgataaacacaaatatctgccgaagcatttttccggcggaatgaagcgcaggcttaatatcgcctgcgcccttgcccaccggccgaaactgatcatcatggatgaaccgacggtcggcattgacccgcaatcaagaaattatattctgcaatcagtgaaaaagctcaatgaaatgggatgcacgatcatctacacgagccactacatggaggaagtggaagaaatatgcacgcgcatcgccatcatcgaccacggaaaagtcatcgccgaaggcacaaaagaacagctgacctccatcattaccgacacgaaggacgtcgtgattgagctgtcgtccggaaacggcatcagcctcggcgatattcaggagctgcccggcgtcagagccgccgcactggaagaaaacagcgtgaaaatcagctctgacacaggggtcaacaatttaaaccgcctgatccggtacttcatggacaaaggcattgaaatccgctccttgcaggaacaggcccctgacttagaaacggtatttctcacgctgacaggcagaagcctgcgcgactgacctaactgaaaggaggattgcaaatgaatattctgcacatcgccgggaaagaaatcaaaatcagtttccgcgacagacggacttttattttcatgcttgcttttccgattgtcttcatgctgattttcaccgcggcattatctaacgcctttgattcagaggtgacggtcggaaacatcaaggtggtatatacggaccagtcaaacggccctctttctcatgattttactgagtttatgaaagccgccaaaaaagagcatgtctattttcaaaaagcggacacggaggcaaaaggcaaaaacgaggttcgagaaaatcaggcggatgctttcgtcactgtaaaaaacaccgggttccaagtctgtacaaatgaccggagcggcatcaacggcacgatcgtccaaggcatgctgaccgcttttaccaatcaatacaaagcaggcgccgccgcttacaaggcgcataaggcaccttccgccggacaaatcaaaagcgattatataaagcagacgtctttacacaaagcgaaagaaccgaaggcgaaagatttttacgcgatatccatgacgacgatgatcgggctgtacgcctcgatttttgccagctccttattccgcggggaaagagtacggcacaccgcggatcgcctgatcgccgccccgctccggaaaagcgatatctttctcggaaagatgctcggcattttggctgtgaatgttctgacgattcttgcccttgtcgccttcagcaaatttatcttgaaagcgaactggggcagccacataggacttgtgctgttgattctcgtttctgaaattcttttggccgtcagcttcgggctcagcctgagctatttgaccagaaaacccgaaagcgccagattaatcaccgtcatcatcgttcaggtaatgtccattatcggcggcgcctattacaaatatgaaggcggaggaatttccgccctgtcgcccttatcctggatcaataaggcgattaacaacatcatttacgcaaatgatgtatcagcggcatggcctgcactcggtttaaatacagcattggcggcactctttttgctgatcgccgcatttacgtttcaaagacgggagggactgtaatatgaaaaacttctggtggctgtttgcacacactctcaaaggaattacaaaaagcaaaaaacagctcattctttatatcggggctccgctgatcggcgtcttcctctccttcatgaccaatgccaacggcggagccgaaacactcaatatcggcattctcaatcaagacggcggagaaatggcacaggatacggtcacgtttttaaaaggactggatcatgtgaagatttcggaggaaacggctgcgtccgcctcatcaaagatcgcttcaggaaaaatggaggcgctcattacgtttgaaaaaggcttctcccaaagcgtaaaagacgggaaaccgtctcacatcggcatgacctcgctgaaaggcgcccaggtcaccggatatgtcagctcttatttgtacaattatatgaacagcgccgcctcactcggcaaatcttccggcggagacgcgaaggcctttcaggcgatgtacgccgatttcaagcattctccgattcaaacggagtccgctgttttacaagatacttcgaaccataaagaaatgacatactcagtcatcgggtatctcattatcattatgctctattccgccggcaacctgacggaactgatgattaaagagagagaaaacaggacgtactacaggcttctgtcaacgccgatcacgtcaaagcagtatgtattggcgaacgcggcggtgaatatgatcatcatggccgtccaaattatattcgccgttctctttatgggcgccgcttttcatattcatccgtcattcccgctgtggcagctgttcgtcctgatgatgctgtttgcattaagcgcaatcgggatcgcctttattgccgtcggtttttccaacagcagctcttcggcatcggcgcttttgaacttgatcgtcgtaccgacatgcttgctcgccggctgcttttttccgggcaatattatgccgaaaacagtgcagacaatcgccgaatttctgcctcagcgctgggtgcttgatacggtcgatcaattgcagcacggccgcacgctccaaagcctgacgctgaacatcatcattttgggagccttcgccgccgccctgttattaatagccgcatacaggttcagcgtaaaacgtcagacacagacatttatgtaaagaaaaacagccccgtaaagggctgttttttcttagaacagaagctcgtccggattcggtccgacacgctcgtctttgtttaatgcgctgatcttttccatttcttcctgtgacagttcgaaatcaaaaatatcggcattttctatgatgcggtgctctttaatcgatttcggaatggtaatgacttcgttctgaagatcccagcgcaaaatcacttgagcaaccgatttgttatgtttttccgcaatttgtgacagcacttcgttatcgaggagctgtccctgcatcaatggagaccacgcttccacttgaatgccctgcgctttgcagaaatctcttacttctttttgagtcaggcgcgggtggaattcaatctggttgaccatcggcttgatttcagcatctttcagcagttcttctaaatgatgcacttggaagttgctgacgccgatggcgcggatttttccgtctttgtacagcttttcaagagcgcgccatgtgtctttatatttatccttgcccggccagtgaatcaggtaaaggtcgaggtaatcgaggccgaggcgctcaaggcttttctcaaacgcgtcaagtgtcgtttcgtatccttgatcttcattccacacttttgacgtgatgaacagctcttctctggcaacgcccgcagctctgatgccttcgccgacaccctcttcatttttataaatagccgccgtatcaatgctgcggtagccgtttctgattgccgcttcgacggagtccgccgctacgcttccgttttccaccttgaagacgccaaggccgaaccacggcatttcaacgccattatgaagctttacagtatcttttaagctttttgccacgttgaaccatcctttctagtcattatgtaaacggttattattatctcacatttccgccgtaagaaaccaattatacgctcatcattatcacaaaaaccatctttagtgcccaagtaccaccaacgttattattttcctattttttcaaaaattccggttaattgggtaactgtccgggtaaatcgctactgtagccaccacacaattgaaggaggaaatcatatgaaacgtatgcgtatcccgatgtccgttgcccttggcgccgctttgtctctgactcctctgtcctttgtatccgcaaaagaaaacccggctcctcaaaacatggctcagcaaacatcagatgtctcagcaaaagatgtcggattaaacattgacgttgacctgctcggcatcggcaattcgattgctgacgcgattaagtcggcgcaaaaccgtgacggcttcgtcaaaaacttaatggaatcttcattctacgcttccggacaaaaatataatgtcatggtgtttaatttaagccaggaatatgaagatcattttaacggcgttcagttttacggttccgccgtttatgacggcatcacgtacggcatttgggtgtttgaagacggaagcttcaccaacaaaggagatggcggctggatcaactgggccttcagaggctggtttgaccgcgacggcgatcacgtcgaattccatcgtccgtaatctaaaaaagtccggcgaacagatgccggactttttttattcatctccgtcaagcatggccgcttccacatcattgatgtattggcgaagctcatgcgacatgtcgcgggaaatttcccgctcttcgaataatgtttggatttcgttgcggatggcctgtacggcccgcagtttgatttcgagtttttgattttcaaaacggcggctcggactctgttcgtgatacgagtgccccagcctgaaaatcaagtgattgtaaaaagaaatgacggcaagcgtcacatctttattttcttcagtcatgtgttttttcaggctttcaatggccgcttttgccgttttaacccttgtggagcgaatgaggccttcttcatttaaaatcgacatttccggctttttatgttcgccgaaaaagatccagtacatcaggcgtttcagctttttcttagataagccgactttaaacgggttcgtatacagcacttccagttcatcaaaccgttcctgaaggctgtcagccgtttcttccggtatgtcgccccgctcaatcagccgcagcaattcttcctgttctgcctgtatcccttgggcgcggactttccgctcatcttttttcgtgcggtttttgacggtgaactgctgaaacctgagatttttcattttctcattgtattcggcaatgaccgcaaaagaagccgttttgtttgtctcattcatattttctttaatggcggttaaggcagcttttatcagcttccgtctcgctgtcagcaatttgactttcttctctttcacattgtcttccggcttatctgtcaaaatcggcagtacgattgtcgccagcaccaatgtgcacaaaataacgcccgcggctaaaaagagaatcaaattccgttcaggaaacggtgagccgtcagagagcacgtaaggaatggaaaaggaacccgcaagcgtgaccgctcccctgacgcctgaaaccgaaatcagcagggtcgagcgcaggccgggtttataaatgctctgatccttgttaaaaaaccacttgccgttccaaaaaaacagcacccacaaaaacctgagaatcattaacgtcagcgtaatgacgataatatacccgatgaccatcatattgttaaacgcggtatcattaaagatgacggaaaccacgtccggtatttgcgcacctaaaataacgaaaacaagaccgttcagaatgaacaaaataatattccacgtacttgaagagacgatttgcagtttgaccatcgttgattcaagacggtcctgctccaccgcatgcgtgatgccgccggccacaaccgctaaaatgccggaaacgccgatttcttcagccgcgagatagatgacgaacggcgtcagaatttgaatcagcatatgcatcgtgacatcctgcatgccgaggcgccgcataaacagccggaaacggataatcaaaaaagaaatgacgacaccgctgagtaaaccgccggctgaaatcagaacgaaactgaaggcggcctgcgccagcgaaaatgcgcccgtcacggccgccgcaatcgcaaatttaaaagcgaccaggccggatgcgtcattcatcagtccttctccttcaaggagacgcagaatgccttttggcatcttcacacgccctgacagcgcgctgaccgcgacgacgtcagtcggtgacaggatcgccgccagcccgaacgcggcggccagcggaatgctcggaatcatccaatgaatcgtgtaaccgccgacaatcaccgtggcaaacacgagcccgagcgcaagcagcagaatcggcgctcttaaattccaaagttccgcacgcggcgtccgttttccatcgttaaaaagcagcggcgcgataaacaaaacaaaaaacaattcagtattcagttcaaaatgaagcccctgcggaaatgacgccgcaatgataccgagcgccacctgaatcaaaggcaccgggataaaggggacaaaccgatttacgatatttgagatcgcgataatggttaaaagtacgagtacgactaaaaatatgtccaaagctgacctccttcatctgctgcatcatatcattattgtctgttctctgcccttgtcaaaggccggagccgatgatcgggcagattcaatatattttccgcacgcaaccattcttcttttattttacccgtttttatttaaaatttctcataacgcgctcacggcgaactttttttgccttcggctacattttttccggaaaaagaaaaagcctgttttctctgaaaacaggctttttcgcaagctgcgtcatctgtttcatgacgcggtgcagcgtttatgctgcttagcaaaggatagagaacgcaccgccagtgtgtctctatccttggttttaagagctcatcttattcgtgaaaattcgtgccgtctgtcgtcgctttaatgatgccggcgcggatgacgaaatcgccgaagtgttcgccttcctcacgctctttcgcgtagcgcgggagaatagtgcgaagctcactcaaaatttcctcttcaccgatattttcccggtacattttgctcaaacggctgccgtcaaacgccgctcctaaatacatattatattttccgggcgcctttccgataaatccgatttcgccgagtgcatggcgggcgcagccattcgggcacccggtcatacggatggtgatttcttcatcccgcagcccgttttcgtcaacaatgtcttcaatcttatcaatcaatttcggcagataccgctcggcttcggccatggcgagcccgcatgtcggaagcgcgacgcaagccattgaactgcggcggagggcggaatactgccggccgtctgtcagaccgtattgttcgattaatgcgctgatttgtttctttttctggctcgagacattgccgataatcaggttttgattagaagtgagacggaaatcccctgtatggactttggcgatttcacgcaatcccgtcatcagcttataattctcatagtccgtgacgcggccgccttcgataaacatcgtaaagtgccatttcccttttacgcccttcacccatccgtaacggtcgccgttatggtcaaaatgataaggtttcgcttcatccagctgccagccgaggcggttttccagctcggcttttacgttttccagcccgagacggtcaacggtgtatttgaatctggcattctttctgacggaacggtttccgtaatcgcgctgaattgtaatggttttttccgctacatcatacagctgctccggtttgcagaagccgatgacttttgaaagctgcggataagtggccgtatcgccgtgcgtcattcccataccgccgccgattgccacgttgaacccgataagacggccttcctccacgatagcaatgaagccgagatcttgagaaaagacatcgatatcattggacggaggcacggcgattccgattttgaatttccgcggcaggtacagcggcccgtacatcggttccgtttccgtgtcaggagtgcccgccacacgttcctcatcaagccagatttcatgataggctctcgtgcgcggaagaaggtcatcgctcaatttcttcgaccattcgtatacttccgcatgaatttcagactggtgcggatttgaagcgcacatgacgtttcggttgacatctccgcaggccgcaatggtatcaagcagcgccgcattgattttctgaatcgtttttttcatgttccattttaaaattccgtgcatttggaacgtttcacgcgttgtcagcttcaatgtattgtttccgtatttttgcgccagttcatccatgacaagccattgttccggagttgacacgccgcctggcatccggacgcgcagcatgaactgataagccggttcaagcttttgtttttgacgttcattacggagatcgcggtcatcctgcaagtagcttccgtgatgcttcatcagccggttgtcatcgtccgggatgccggctgaaatccggtcgagcatgacttctttcaatgtgccgcgcaaataatcgcttttttctttaatttcctcaacatcacttggagggccttccggcgcttttaaaatgttgttcaccatgctgaataagctcctttcaaaccaaaatcaatatacatcacgctgatagcgttttttctgctgcatgtctgccaggaagctttccgctttttcacggctcatgccgccttcttcctgaatgatatcgagaagcgcctggtgcacgtcatgcgccatatgctgttcatcaccgcagatgtatacggcggctccctgctgcagccattcatacagctctttgctttgttctttcatgcggtgctgcacatatactttttcctccgaatcccgggaaaaagcgacgtccatttttgtgagaacaccgttttgcagccatttttgccattccgtctggtacagaaaatcagtgacaaagtgctgatccccgaaaaacagccatgttttcccttcagctccggtttcttcacgctcctgcataaaggaacggaacggtgcgatgcctgtccccggcccgaccataatgatcggtgtatccggattttccggcagcttgaagttttggttgtgctgaatgtaaatcggaagcgtatctcccggctggagtctttccgcacaaagaatgctgcagacgcctttgcgttctctgccgtgcgcgtcatatctgaccgctccgattgtcagatgcacctcttccggattcgcttctaaactgcttgcgatcgaatagagccgggccggcattttacgcaggatggaaagaaagtcttccgcggaagcttcccacggaccgaaatcccggacgagatcgagcagatcacggccgttggtgtatgctttcagctgctcttcgtttccttcggccagaagttcactcagcttttgatcagccgtaaactgtgcggccttttgcaaaagcggctttgttaagacggtaatttcaaaatgagaagtaagcgcgtcttccagcggacggcgctctccttgtttattcaccgccacttcctgttttgggtcccatttcagctcattgatcagctcatcaacgagcgccggatcattttccggatagatgccgaggctgtctccgggctgatacgcgaggcccgatccttcaagcgatagctcgagatgacgtgtttctttattcgaaccgcgtccgttcagattgatgttctcaagaacctccgcccgaaacgggttcgttctggaatatacggattcaccgagagcgggcgtctcggcaggcgcttcggctgtttgatttcccgctccttcgttcaaaccgccgatgaccgcgtcaagccattccgaaaacggctcatcataatcaagatcgcaatcaacccgcggcgcaagctgggtgccgccgagctcttgaagacgctcgtcaaactctttgccggtctggcagaaaaattcatacgagctgtccccgagcgccaaaacggagtaacggagcgcttcaagcttcggcgcgcgtctgccgtgaagaaattcatgaaaggccagcgcgttatccggcggatcgccttctccgtgcgtgctcaccacgatcagtaaattgtttacttttttcagattattcggcttaaaatcgttcatcgacgcgacggtgacctggaatccccgttcctcaagcgtctttaccgtctgtttcgcaagaccttccgcatttcccgtttgcgatccgtataatacggtcacttctttcgagactgccgggctttcagcaggagacggagcagcgggcgcggctgtttcaccggattcggaccgggcagcagccaaatagccgctcagccagattttctgtgattctgtcaaggtcggcagaaggcggttaaggagctctgcctgctcctgattaaacggactgttcatgacctgaagttgcaacgatatccacctcacaaggaattaaacgtaacgtacgttatttctataggaattgtcaaaataatattctaattgaaactttaccgaaagtttgtatgtaagtaaaatatataatcatgatgacaacgattaagattactaatgataaaaagccctttgcactcggcaaagggcttatacgaataagccggcgggcacttcttttataaaaggagagggttctcccgaggacaatacggtcagatgatgcatcgcccgcgtacaggccgtatataacagcttacggtcatgttcgctattgtactgggcagcagaggcgtcagcggcaatgacggcgtcaaactcaatgccttttgccaaataaacgggaatgacgcatacccctttttgaaaaggctggttttctttattgatcaagcggacaccgctctcggcgctgactgcctgaaacacttttttggcttccgcggccgttttgcagatgacggcgaccgtctcccagcctttttgtctgagctcccggattgtatccgccaattgttcctgccgcgcattttctgtatccgtccgcaaaacacgcggtttttccccgttccggttaaaaggctcaatgtcatcgccgtcagccagcagcgctttcgtaaattcaacaatctgccgcgtcgatctgtaagtccgcttcaggctgacatacttttctgcaccattgcgaaagcagccggcgagggaagaagggcccgtaatggtgtgagcataaatcgactggctgacatcaccgagcaccgtcatctttgccgccgggaagatgctttgaatatacgtgagctgaaatgaggaataatcctgcgcttcatcaatgaagacgtgcttcatttgtgtgttttttctttttccttctaacagatcctgcaaataaagatacggagcggcatcttcatacggaagcgaccgttctgcaaatgcgtttctggtcaaagcgccgatgctctcccaatgatcgggcttttcatcagctccccagtctgaaaacagccggagatacatccgttttatatcgagaaagccgagccgtctgacggcctgcttaatcggtttaaaggctttgccgacaataatggcgccaagcaggcgctgttcgcgctgatggtcgtcaaatgcaggttcatcatctgccgcctgcttcttgagtgtttgataaacctcagcatagtcttccttatcaagcagatcgctctcctgcaagacccattccttcttacgctcctttttttcgagagcgctgatttccgcgagaagccattccgccgtcagctccgctctgttcggaatcggcagctgctgatcaagcgaataaaaataggcttcaatccgctcttttgaaatcaggatgtctccccgaaagctgatctgtttacatatcaggccggagaccgaaagcgacccggcatagcggtcaatcagggcctggaaagctgacgacgctttgtaagcaatggctgcgagccttacggaaagtgcgtcctgattttgttcagtcaggcaatattcaagctgctcgtacgggctttcacaatcaaactttcgtccgagccggcggatgatatattcctgaaaggtggcctgctccatattctcttctcccaattccggcaatacggcggaaacataactgttaaacaaaatgttcggggaaaacaatacaatctgacgggcatcaagcaccccgcgcccgcggtacagcaagtaagcggcccgctgaagcgccgcggatgttttcccgctcccggcggctccctgaacgatgagatatttgcttttttcatcccggatgatttcgttctgttctttttggatggtcgacacgatgtttttcatatgctgtccggaatggccgctcagcacctcttgcagcatttcgtcaccaatcgtcatatccgtgttaaacatcgctttaagcgtcccgtttttaatgataaactgccgcttcagtgtgatgtctccctctatcgtttcttccggaacttcatagcgggcttttcccggggaatattgatagtaaagagatgagatgggcgcgcgccaatcataaatgagaaattgctcgttgttttcatccatcaaagaagtcagcccgatataaatccgctcggaagaggactcccctttttccgtaaaatcgacacggccgaagtaaggagaggttttcagcttttggattttttgaagctgccggtattgaagccgatgcgtccgttcacgttctgaaagcatttccgcctgctgtttaatgcttgaaaatgtctcagccgcttcatgggcgtcatccatattcacggtgacatcatcccaaaacgtttttctcaggccgacaatatcctgcttcaaaccgcccgatgaggcttcaagatgagtttgtttctgttccagttccttcatgacaaaattgattctttcctgctcttctttccactctttatcacgttttgccatcagcggcacctccgagatcaagctgacaaatccggctttcctcatacaaacatatatgcaacatgttattcagcattatggtcaaataccctttttcttatcatatcgggcgtctttttttatcagaagccgttatgcaaaaaaaccgatttcgtttgtgaaatcggtttttttactgatctatatgataggaacgaatcggcaggcgccacctgaacacataactgcagatgcggcatgccacaagcacaagaaacagcacatacaaaccggcggcatccccggcccagccgaggcccacgattaaccctccgagcgcggcccagactgcatatatttccgccttgagcacaagcggctttctgcccgcgagcagatcccgtatgatgccgcccccgctgccggtcaggaccgctgccgcaatcaccgcactgagcggatggcccattttcacggcatataaagcgccttggatggcaaacgccgatagcccgatggcatcggataggttgccccatttactccaatgccttaacagcagcttcggaaacaaaaagacaatcgtaactgatgcgagagcgatttgaaaaaacgcgccttgctcccacaaggcggagaccggaacaccgatcagcagatttcggatggctcctccgccgaacgccgttacaatccccaagatatacacgcctaaaatatcatactcctcttccatcgcaacaatcgctccgctgaccgcaaacgcaatgatgccgattacactaagcagctcccaggccattccatatgctcctttttatttgttaaattttctgacgaccattagattttataatcgctttctcttaaaatcaaccttatttttgaaagattctgattcctgatccgggacaacctcacccgcaacggctgagagcgagaatattttcctattttatactttaatgggaggtttattggaagtttcattgaatactttctctaacaaaaaggggggtatgagatgaaaatcagttcacttgtttttcctgttttattggccgccggattaattcccggcctgccgtcagccgaaagccatacgcattcgcacactcatgcggagccggcgaaaacggtgtatacggacccgcttccgaaagccgatcattttaaagatctgaagggcccggtccaagttgaacagacggttgacacaaaaattctggatgagaacggcaagcaggtcggcacaaaacgattcaatgccaatgtcagtcaggataaagcctcaactaaagccagcacgggcgctcagaaggtcagagtgctggcggtggcggacgctgaataccgcgccaaatacagcgactggcaaacgcgaatcgtccagatcgtggagcaggcggatgtcgcttttaaccgtgatcacaacattgatttcgtcgtacaggccgtgcaggcttggaattcctccggctcaaacagttctcagattttatcgaatctccaaagcagcttcagaaatcaaaattatcattttgtcgtcggttttaccgcaaaatcaagttttgacgccggcggtatcgcgtatgtatataacggcaaaccgagcggcccggctttcagcgtgaaccttgatcaaggaacggccaacacggcgaaagcggcacagcacgagttttcccataacttcggacttcagcatgacgcccaaggcagcggcatccgctgcgtcatgaattatgattatgcctattccgtggatatctgggacagctcccataacagacagattgcgacaaacaaagcttggtacaaataatagaaaaagagccgctccccatggagcaggctctttattttgccgtgcgttccgttttgacaaaacacatgcagatcataatgagaataaatgccgtcaatgccaagaaaggaatggtaatgaaaccgaaccagttaatatattcagatgagcaaggcacgccgtagacacacggcttgatgccgctgaaaccgggcaccttctgctcaaggtaatgcatgatcgatataaacgcgccgatgacggccatcggcagcacatattttttcacgcgcgtgtcaccctggaaggtggcgattcctaaaatcaggacaagcggatacatgagaattctttgataccagcacagctcgcacggtatgaattttctgatctcgctgaaataaaggctgccgagcatggcagcaagagctatcacccaagaagcatataaaaatacgattctatttttcatttttcagctctttcttaatcgtttttgaaatttcctcataattagagaattctttaatcactttgtcatttacgtaaatcgtcggtgtcgccgtaatgtttaatttatcattcaggtcagtgtcagctttcagctcttttgcaaatgtctctttatcaaggttttccttcagcttgtcaggatcaacctttttcgcggtgcttttgaccgttttttcaagcaatgcaggcgtgacccattcctgttcgcttgacggctgctcttcaaacagcttttcatggaaagtccagaatgatgccgggtcttccttccacacctcttctgaagcaagtgccgccagacgcgagccgcttccgtggtacatgacgttcacaaatgaaaatttcacgtcgcctttatcgataaaatcttttttgattttcggaaagatatcgctgttaaatactttgcatgacggacatttgtaatctccgaattcaactaccgtaacaggcgcgctgtctttgccgagcacgggctgtcctttaatggaaggctgttcggcggctgtttcgcccgctttttccgtttggttgttaataattacgatggccgcaaataaaacgacaacgattaacgtcagaatcaccgcaaatttcgcagacgattgtttctttttcactcagacacctcattgtttttaaaataaaaaagaagcggatgccggatggcccgcttctctattttaccaagacaaccttgtttaagaaaaccctgaaaaacgaattatctttgacaattattccgctttcactctcatgacgcgcatcgcattggcaacggcaatcagcgtgacgcctacatctgaaaagaccgcttcccacatggtggcgaatccgaatgcgccaagcaagagaaaaatgatttttacgcctaaagcaaatccgatgttctgccagacgatccggcgtgtgcggcgtgcaatccggatggcttcggctgcttttgacggctggtctgtcatcaggacgacatcggccgcttcgacggcggcatcagaaccgagagcccccatggcagctccgatgtcagctctggcaagcacaggcgtatcattaatcccgtcgccgacaaacatcagtttttcattcggtgaaagcgcggcttcaagttcttcgacgcggtctaccttgtcaccaggcaaaagctctgtgtacacgtcatcaataccgagctctcggccgacagcttctccggtctgctttgaatcacccgtcagcatcactgtccgcttcacgccgagcgcttttaacttggcaatggcctgtttggcgtcctctttgatttcatctgcgatcacgatcgcccccgcatactgctgatcaacggcgacataaacgacggttccgttattttcagctgtgccggaagcgatttgttcttttgccatcagtttttgatttccggccaaaatcgttgatccgccggttttcacccgaatgccgtgtccgggtatttcttcatattcttcaatctcctcagccgcgagcggttgattgtaagcctcacggatggaagaagcaatcggatgattggaatggacttctgcaagcgcagcagcatgaagcaggctgtctttcgtaaatcctgccgccggtttgatatcagtaacggcgaaattgcctttcgttaaggttcccgttttatcaaacacggcgtatgccacctgattgagcgcttctaaatagttgctgcctttcacgagcacccctgctttagacgcagccccgataccgccgaaaaacccgagcggaatggagacgacgagtgcgcacggacaagaaatcacaaggaaaatcagcgcgcggtacacccagtcggatagcgcggctgaaggcacgagaagcggcggtaaaaaggcgagaagcaccgcaacaatgacaacagccggtgtatagtacttggcaaacttcgtaataaagttttccgttttcgctttgcgtccggccgcattttcgaccagatccaatatttttgacacggcagagtcttcatatcctttagaggtttcaatatgaagcacgccgttctgattcataaatccggccatcacctcttgccccggctccgcttttctcggcacggattcgcccgttaaagcggatgtatcaaccatcgaggaaccgctcagcacctttccgtccagcggaatccgttctccgggattcacgatgatgacctgtccgactttgacgtcctgcgggggaacggcagccatgccgttttccgttttcacattggcgtactcaggacggatgtccaataacgcgctgatcgattttctggatcggctgacggccgctccctgaaacaattcaccgatctggtagaacagcatgaccgcgacgccttccggatattgatgaatgataaatgcgccgattgtggcaagcgccatcagaaaatgctcatcaaatacctggccgcggacaatattttttcccgctctggctacgatatcgccgccgatgatcaaatatgaagcaaaaaagagcagaaactcaaggacggcgcccgtgtgcgcgaagtaagcgatgacggccaaaacggcgcccgccgccaatctcactaacatcagctgcagctttttgcggtattcatccccgccgggtttgtcttcgtgcttcgaacgaacggtcacatgaggatcaatggactttacttttttcgcgacttcgtctttcatccattgctcgtttttcccgccggctgagaccgtgatggtgcttgccgcaaaattgacagcacagccgtctatgccgtcaatggcttttacgccgttttctattttttttgcacagttgctgcaatcaagtccgtctaatacaaattcacctttggctgctttcattttcgactcaccctactttccgtaataggattcccataacatcaatacagctaaacgaatttatatatatgaacatatactcatatatgtgttttctctattatatgcaggctttgaataaagtgtcaataaaaaagacaaaaccggcatcagccgattttgtcttttttcaccttctgtaaacgcaaggcattaagcacgaccgataccgagctgaatgccatggcggcgcctgccacccacggagccagaaagccggctgccgcaatcggaatgccgatgctgttgtagcccaatgcccatcctaaattctgcttgatgtttctcatggtcagcctgctcatgccgatggcgtcggcaatgccgttcaggtctccgcggatcagcgtaatgtccgctgcttccattgcgatatcggtgccggtgccgatggccatcccgatatcggccacagccagcgccggagcatcattgatgccgtcaccgaccatcgccacgcgccggccttctttttgcagccgggaaatttccgccgccttttgttcgggaagcacttcggcgatcacgctgccgatgcccgcggcttttgcaatggcttccgcggtctttttgttgtcaccggtcatcatgatgacgtcaagccccatatcattcaggcgtttcaccgcggccggagatgtttctttgatggtatcggcgactgcgataagccccgccgctttgccgtctgccgcaataagcatcaccgtttttccttccgcctccaagcgggccatgtgcggaagcagtgcttcatgttcaatgtgctctgattccatcagccgtcttgatccggcaagaatcgttctgccgtcagcctctgcatagattccggaaccgatccgggcttggaaccgggcgagtttcgggatggaaatcccccgtttttcggctcctgacacgatggcttctccaagcgggtgctccgatcccgtttcggcggccgccgccagccgcaggagctcctcttcgttcattcccgctgccggtacggcgtctgtcagcaccggtctgccgtttgtcaccgttccggttttatccagtacgatggtcgtcagacgctgggtcttttctagatgctccccgcctttaaagagaatgccgaattcagctgcgcggccggagcccgccataatgctcgtcggagtggcgagccccagtgcgcacggacaggcaatgacaagcacggcgatgaatttgccgatcgcttcagaaaactgtcccggcgccgcccatacataccaaatgagaaaagtcagcacggccagccccagcacaatcgggacgaaaatgcctgaaatgtgatccgcgagccgctgaatgggggcttttgatccttgggcttcttccacgattttaataatgtgtgcaagcgcggtatctttgccgacattcaccgctctgattttgagaaagccgtttgcattgatcgtcgccccggtgacggtgcttccgggagacttatcgacaggcatgctctctcccgtaatcatcgattcatcaatcgcggaatggccttcaatcacttcgccatcgacaggaacgcgttctccaggtttcacgtatacgatatcccccgtccggacctcgtcaatcggaatcacctgtactttgccgtcccgctcaaccgccgccgtcttcgcctgaagcttcattaactttttaatcgcttctgatgagcggccttttgctttcatctctaaaagctttccaagcaaaatcaaagtcagcaaaatggcgctcgtttcataataaagcccctcagcatgtccgtctcgtccgagagacgcaatcgtcatgtacaggctgtatgcgtaagcggccgtcgttccgagcgcaacgagaacatccatattggcgcttttgtttctcagcgccttgtacgctcccgtataaaaaggccagccgatgacgagctgcaccggggtggcaagcgcgaattgcagccacggattcatcaggatatccggcatccagataaaagaagtaaaagaaaaatggctgaccatcgaccataaaagcgggaaggagagaacggcagaaaatatgagcctgatcagctgctttcgctgctctttctccttttgggataatccgccgtctccatcaaccgctttcttctcgtctaatctgtagccgagttttgccacggtctctttcagctctttcggtgtcacctctttcggattgtattcaacggtgactgtttccagggcgaaattcaccggtgcgctcacaacgccctctgttttgttcaggcgcttttcaatccggttggcgcaagcggcgcacgtcatgccttcaatctgaaaatcggctttttccgtcacgacgtgatagccgagtttttcaattttatcctttatggcgccagcttcgattttgtcaggctgataagaaatatttgaggtctcaagcgcaagattgacggaagcgtcaatgacgccgtccatccgtttcagccctttttcaattcttgaagcgcaggcggcgcatgtcatgccccccacttgaatggttatctctttcggttcactcaatgtcctcatctctcttcataaaccccatgggggtataattatgataaaagaaaaccgcgcccgttcccgaagcgcgataaaccttatacgacgtcatacccttgatcttcaatcgcgtcctttatatctgatacggagactttgttctcatcaaacgtcacatccacctgtccggcttccaatttcacctgaaccgccgtcactccgttcagttctcccactccggtctctactgcttttacgcagtgctgacaggacatgccttcgacttgcagtgttttttgttccatgatgattccctccacgtcttgttttttcttttttatgttaccatacccctgtagggtatttcaaaacattttattttacgattttgcgatttttttcacaacatcaagcagctcggcaatcgcctgctccccgtttccgctctcaatggcgccggctacgcagtgatgggcgtgatcttccagcagatgaaacgcgactttctgcatggccgcctgtacggctgaaatctgcacgagaatatccacgcagtatcgttcgttttccaccatattctgaatgcccctgacttggccttcaatccgtttcagccggttcagaatctggtctttttccttggcgcttttatgatttaacgattgatgctcggtatgtttgtccattttccacctcggttttgttcttcgttaccttcattatacagacttgaaaatccggtgtaaaaaattttcaacacacaagttttaccagtacacccgcggggtatatattgttatcacatatcatgagggggaagttcattgaaaacgatacaggttggcatattgggatatggtttgtccgggaaagtctttcatgcgccgcttttggacgtccttgatgattatcagatcaaaaaagtcatgacctccagaacggaggaggtcagacgtgatctgccgggggctgaagccgtgcgcgcgattgaagacattaccggtgatcctgacattgatctcgtcatcgttacgacaccgagcggaatgcattatgaatcagcgatgaaatgtctcctggcgggaaaacacaccgtcgtggaaaaaccgatgacggcgacttcagcagaagcggaggagctgagaagaacggctgaaaataaaggcgtcttactgagcgtgtaccacaaccggcggtgggacaatgactttttaacgatacaaaagctgattcgggacggggcgcttcaagacattcatacatatcaagtcaactacgatctgtacaatccggttgtccaagaaagatggcgcgaaaaaagcggacccgccacgggaacgctgtatgatctcggttcacatattattgaccagacgctcctgcttttcggaatgccggaatccatcacggcacatgtgatgaaacagcgggacaacagtgaaaccgtcgattattttctggccgcgctccattacggcaaacttcaggtcattcttcaatccggctccatgaatgcggcaagcggcccgcgctaccagattcacggacggaatgcaagctttatcaaatacggaaaggacggacaggaagaggcgctttcagccggacaaaagccgattgacgagagctggggcgccgatgaccctgacaacttcggagagctgacaatcgcagcggatgaaaaacggcatacagaaacaatcccctctgagaacggctcttaccttacgtactacaaactgctggcggacagcatcttaaacggaaaaccgcttcccgttacggcaaaagaaggcatcgatgtcatccgtgtcattgaagcggcgatgaaaagcagcgagcaaaaacggacgattgccctttaatatgaaaaacctcccagccgtacggcggggaggtttttttaagatcagaatgattttccggcttctttcgcgcgggcaatcgcatcttctttaatttgctgtgctttattcggttcagcattatggccttcaacgattaaaccgtcaaaagaaggaacgccgaagaagttcatcatgatgccgatgtaacggtggcccatttccatgtcagccgccgggccttcagagtaatagcctccgcgcgcctgaatgtggagcgcttttttgtcagtcaacagaccgatcgggccttgctctgtatatttgaatgattttccggctacagccacagaatcaaggtacgctttcataacaggcgggaatgagaagttccaaagcggtgtgacgaatacgtatttgtcagctgacgcgaattgatcgctcagctcgttcagacggccgactttcgctttttcgttttcagaaagctcttcaaatcctgtgccggattgaagttttccccagccgctgaatacatccgcgtcgatatgaggaatgttctctttgtaaaggtcgatatgtacaacctcatcattcgggtttgattctttataagaatcgataaacgcttttcctgtcgccatgctgtaagatgtcttttcatcatgaggatgagcagtgatataaagtacttttgccattgtaaacagccctttcgttttcaaattacacacacatttattatgaaatatgaatgtttttttatactgatcagttctgtaataattatagttacaaaaaattcttttcgcaacaataatatctcgaaatcagtatattttttaaaaaaggctgtaatgacgggaatggcaagcagcagaaaaagcagaaacatttagtttctgctcaaaatcggatttggtttgcagaccggaatatccaacccgagattcccccgcagtgtatccgccggatagctttttcggtacagccccttttcctgaaggatcggtatgacttgatctacaaaggcttcaagcatgcccgggatgtcagagtgaatgataaacccgtccgccgcttcccgctgaaaccatgtttcaattaatgatgccacacgttccggtgtcccgataaagttggttcgcggaaacgcggcttcgcgcgccacttgacgcagcgtaagattcctggctttcgcctctcttttgatacggtctgtcgtgctttgaaacgcgtttttcccgacgtcgcccaaatcaggaaacggctcatccagcggaaaacggctcagatcataatcgtcaaaaaatctggccacatatttaacggcgttctctatcggaatcagctcggcgaattcctgatatttcgcttccgcttcttcttgtgagccggctataatcggactgattcccggaaagatccgcagcttggaagcgtcccggccgtaatccgccgcccgcttcttcacatcatcataaaaagctttcgtttcctcaagtgaattggagtgcgtaaagactgcatctgcattcctcgcggcaaacgaccggccggtttctgaagaccccgcttggaaaacgaccggctctccctgtttggaccggccgatattcagcgggccctccacttgaaaatactcacctttgtgatacaggcgatgcagtttgtcagggtcaaaaaactgcccggtttctttgttgcggacgaaggcatcttcttcccaggaattccacagaccgcgcaccacgtccacatgttcctgggcgatgtcgtagcgccggctgtggtcgggaaggctttctttgctgtgattgcgcgcggctcccgcctgcggagaggtgacgagattccagcccgccctgccgccgctgatatggtcaagagacatcagctgtcttgcgatggtaaacggctcagtgaacgaggtggaaaatgtgccgattaaaccaagatgggttgtagaggcggcaagcgccgataaaatagtgatcggctcaaaccgatttaagaaatgcgggatggacttttcagaaatgaacaagccgtccgcaataaaagcaaagctgaacagccctctttcagcagtctgcgctttttgcctgtaaaacgccgcattcgtgcttgctgtcggatcggcgtcgggatgacgccagccgtccgttgtgccgccgacaccgtgaatcatgactccgaattgaattagatccgtccggctcattttctcaccccctttttcccctcgtaatcggcaagcgcccgttctacatgttcaatgccgacttgagtaacggcctgatacacacggctgtcaccgctgccgatttcaacgacgggaacatgacagatgccgtacttcgtctgcagcacgtcacgcaattcgtcccgctctgtcacatcaattgtttcgtatgccacggctttttcccgcaaatatcctttcacttcatcacaataggagcagccctgcttgctccagaccactacgtttacttcatgactcatgttcatccctcctgtaattgtggggccggctgcaccgcttcgcttaacagccggtaagacaatcgtttttcctcagcgtttttgataggcgacaaaatcacaaaatcggtaatgctgtattgaacggataatcgtcgcagctcggcggcggtctcttcttttgtcccggcaatcacacccgtcttttgtgtgatcagcttatatggctgcgtgacttgttcaagaaacgcttccgcttgttcccgggaaccgacattcacctttttgccgtcttcgagaatgattttgaccgactcacgcgatacgacgtgtttttccgcttctgcttttgtatgtgcggtaaataccatcggcgcaaggtgaaattccgccttcgatcctttcagcagatgctcgtcaaaggcgtggcgcgctttttctaacgcagcctcttcaccgtttatgaaataggcgaaaacgaaggaaatgccgagtttggccgcggatatcgcgctttccgcgctgccgccgagtaaaaagatgtcaggcgcatactcagtatgcggcgtcggccgcaatgacgcgtagcggtgcgagtccggaaaatcatttcggatgaaatgagtcagctcctcaagcttttcttcaaacaaacgggcgggctggataagctcccgctgcagcgcatcggttgacagctgaaatccgccgggcgctttgccgacaccgagcgccacacggccgggagcaagggcggacagaacccggaactgctccgccactttataaggactgtaatgctgcagcatcaccccgccggatgcgagacggatttttttcgtgcttgcggcaagataccccagaacaatttccggcgctgatcccgctatctcttcattgttatgatgctccgccgcccagaaacggtcatatccgtattgttcggcctcctgagccaatctcaccgtttgccgcaaggcttcttctgcggtttggttttccgcggtgacactttggtctaaaatgcttaaacgaatcatacgacaggctcctttatgcgctcttttatgtcataaccgtaatcaggcagcacgcggcggaggaacttcttcgttctttcttttttcgtcttgtgaaaaacttcctcaggcgttccttgttccacgattgctccttcatccataaacacaatttggtcggacactcttctggcgaattccatctcatgtgtgacaatgatcatggtggcgccggtccgcacaatgttaagcatcacctcaagcacctcgccgacaagctccggatcaagggctgcggtcggttcatcaaacagcatcacatcaggatgaatggcaagcgcccgggcaatcccgacccgctgcttttgtcctcccgacagttgattcggataggcatgcaatttatcctgaagccccaccttggccagttcccgctcggcaatggcgtacgcatctgattttttcattttccttgcgaccgtcaggccttccatgacattttgaattgccgttttatgcgaaaacaaatgatattgctgaaaaaccatcgccgtctgtttcctcagtctgagaatgtcttttttggcaggctttttgcagttaatgacttcaccgtgcagcgaaatggcgccctcatccggccgctcaagtaaattaaggcagcgcagaaaagtggttttcccggaaccgctcgggccgatgatggtcacgacttctcctttccggacacttaaattgatcccctttaacacgtgatgactgccaaaatgtttctgaatgtttcggatttcgatcataatgcgcctccttgatatctggccgctcttttttccgccagactgtttacagcttcgagaatcagcgttaatccccaataaatgacggccgccccgataaatgcttccagaaacgcatagttatcggatgccgcaatcgtcgccgttcctgtaatttcaggcactgcaacaattgccgcgatggaagtggtatgcaaaaagccgatgcctatattggtgaagttcggcagcgatatcatgaacgcctgcggcagaattacgcgccgaatcatctggccccgcgtcagaccgattgaatatgccgcctccgcctgccccgtatcgacggccatgatcccggatcggagaatttccgtcatataagcgcctgccgttaatgacagtgccatgatgacaaacacggcgaccggaatctgattggccgaccagccgagatgaaacgcgcggctgaattgttcggcaatcagcggaacccctaaataaatcagcatgatatggagaatcgccggggtgctgcggaaaaaagacacgtaaaacgctgagcaggccagcagccatttgatgcggaatatacgcaccgtgatattgccgagagctatgaaaaatccggcaataatcggaatgaccgtcatcgccaatgtaagcggaacggttttcaacatttgttttatcgcagtgccgataaatggaatgtccagctccactgttctccctccttttcagccgtgcgcactcatgtcaaaaaccgtcacaaggcgcgtctcatctttcttgattcgtttttcggcccatctgaagacacattcaaataaaagggcggccgcgtaatacagaacagacagcgagatatacacttcaagagaatgattgctcgatgtaatcaaggtctgtcctctgcccgacatatccatcaccccgatcgaaaaagcgagtgatgtatcttttaagaaaccgatcaccatattcccgatgttgggaaaggcctgcacaagcgcctgcggcagaatgatgcgccggaatgtctgccccccgttcagcccgatgctgaacgccgcctccgcctgcccgcggtcgacgctgttcacacctcccctgatgatttcggccgctcttgccgcgctgctcagcgcgtacgtggcgatggccgcatacaaagggtccattttagaggtatcaattccggcgagcgccgtgagcgccggaatgccgtaaaatacaatgaacagctgcaccatgatgggcgttcctctgaaaaaagagatatacagcttcgcaaactgattcaaaacgggaatgcgatagatgcggggcagcgccaaaagcagccccaatagaaagccgaacagcaaagacaccgccaatatatacagcgtgacgggcaaatacccgagcaatgtcggcacaaaggacgcgatcatactgatatcaaacgctttttccattgccggtccctctctttttcacttaatattgctcctttgaataatccgcgccgagccacttttcactcagctttttaagcgtgccgtcatcaatgatttccttgagcgctttatcaatgtcatcgctcagcgtttgttcatttttgttaaacataaagaacactttggcatttgacagcaccccgccgaccgttttttctttgattgcgcttgttttgttttgaaaatcgacagcaaacggcgttgaaatcgttgcatcggcgcggccggatttcagctgattggccgcatcgtttgaaccttggccggcataggcgatttcaaacggactgccgtgtttttcattccattttttcagcacaagcgcgccgtttgacgtcggacttgtaatgacccgctttcctttcaagtcatcaatgccgtgaatgtccccgttatcttggagcaccgtgattttcagcgggaagttgttatacgcgacttgattgaacagaaattttttctcccgttcggcgcttttctccatttgatgagccacgatatcgactttatgctggccgaggctgacaagcaggttggagaaatccatcgttttaaaggtgaatcgatagtccggcaggcgcctgtcaagctctttcaccagctcaacgtcatagcccgtcaatttgcctttatcatcaataaagcaaatattcggaaattgagtgccggtgccgaccgtaatgttcttcacgtttttctgattgcctgatgccgcctccccgcccgcgccgcaggctgataacgccgccgttgccgcaattgttaatgacatgaccgccagtcttattttcatgtgatcgccccgttttctgcttcaattatttcgtgaaacttgattttgaataatccgcgccgagccatttttcactcagccttttcaatgtgccgtccttctcaagcttttgaatcgcccgatccgtatcgtccgccagggtttggctgtttttattgaacataaaatacacctcggtatcgagcagcacatcaccgaccgtcttttgtttgaacgcgtgcgtcttattttgaaaatcgacggcaaacggcgtggatacggtggcgtcagcacgtcctgtctccatttggttcgctgtatcattgccgccctgcccagcgtatttcaagtgtatcgggctgccgtgggacttgttgtatgccgtcatataatccgccgcatttgacgtcgcgccgacgatgacggttttcccttttaaatcccggagcgtgtgtatcgcgtcattatccgccttcaccgtaatgtacatcggcgagtagttatacgggattttgtgatacaaaaagcgtttctcccgttccttgtttttcgccatattgtgcgcgatcacgtcaattttccggtttccgagacttgtaagcagattcgaaaaatccatcgtcttaaagacaaatttgtattgcggcagctgttcatcaatggctttcatcacttcaatgtcatagccggtcagctcgcctttttcatccataaaagcaatgttcggaaaatcagttcccgtgccgacgataacggtctgcacgccgctccccgctttcgtgctttctccttgcccgcacccggccagcacgccgagcagcagaagcagacagccggctctgatccgtttttttatcattgcgcccagctcggtgtgcctaacagcgacgcgtcaaaccgctccggtatgagcacctttctcatcatgactccgatgtctccgtctttctcctgctcaaaatacacttcatatcccctccgtctgtacatatctacaagccagggatgcttgcgcgccgaagtgccgagcgtgatggccggggccttcagcgtatcccgcagcacatgttcctccacataagtcaaaagtttgctgccgatgccctgccccttcagctcaggaagcgtcgcaaaccaccagacaaacggatattttgacggaggcgtgtcactctcccacggaaaacggatcgtaattgttgaaagaagccgtccgtcccgttcgagcacgacggctgaatgattttcaatattttccgttaccatatcgatgtcggcccgcgccgacggccagtcaatctccaaattgcggatcggctgaaacgcgctgtacagcagctctaaaaactccggcgtatcctttttctcagccaatcgaaatatgtcttcactcattccggtcactctccccgcaaaaaaatatataattccaatttgtttactaagctttgattgtttatactataaagcaaactgatttgtttgactaatcaaaaaaagtaaaggaaaggttcaagaaaattaatgaacagccgggaggggatttcgttggaattacgcaccattaaaacgtttcataccatcgtacagtcaggcagcttttataaggccgccgaaattctgaactactcacagccgacgatttcaatgcggattaaacagctggaacaggatgtaggcgcgcagctgtttgaacggggaaagaagctgaagctgacaagggcggggcggctgtttcatgagcgggccgggcagcttctcgcgcaatacgaggtgcttgaccatactctggccgatatcagacagggccaggccggccttattcagatcggcatatccgaaccgacggcaagcctgatcttccctgccgtgctgcggggtttcttaaatgattatccggacatgtcggtcaatgtcagcgtggatgatgccaatacatgcagccgcaaactgctggagggcgccattgattttgcggtatgcggcgagccggagctgattctggaaaattactttgatccgtttttccatgactcgctcaatgtcatcgtgtccaacagacatccccttgccgccaaagcaagcgttaatctcgaagatttagaaaatgaatgcctgatttttacgcccgccaattgcccgatccggattcaaattgaacagcacctgcagcgggccatcggcagcagctatcgaaaaatggagctgaccagcagcatggctcaccaatactatgtcagggaaaatatcggcgtctcaatctttacggcgacggcgcattcagagccgatcgagggcacgaaggtcattccgatccataacttaacaatttcaccgccggtcgggctgttgacaaaccaaaaagaagagcattttgactgtgccacaaaagatttaatcagcaggatcatcagccggtttcagcgtgatccgcattaaaaaaacccccgctttacgggggtttttgtatgttcatcttatataatgctccgcaccaagccgccgtcgatccgcaatgcagatccgttaatggcagacgacagcgggctgcttaaaaaggcgacaaaatgagcgatctcttccggacggatcaatcgctgaatgatcgacgtcggacgattttccttcataaatcgtctctccgcttcagccactgtcaggttttcaccgggataaagcgactccagcattgtttcgacgccctctgttttcgtggagccgggcatgaccgtattcaccgtcacattcgtcccttccgtgagctcggccagactgcgtgacagcgacagctgcgttgttttcgtagcgctgtaatgagccatttcctgagaaggcatgacggccgcttcactcgcgataaagatcacccgtccttccttccgctcaatcatccgctttgcataccggcgtgtcagccgcacgccgctcatgatattcacctcgaaaaaccggagccactcttcgtcaggaatatcaaagtattccgcaggttcaaagattcctaaattgttgacgagaatatccacatccggatactgctgaaaaatcgcgccgcatccttccgccgtgcctaaatcaaatgcggccggatagagacgggcatccggcgtctgtttctctagttcccggatcgtttcgttcaccttttcttcacggcggccgttaatgatcacggccgcaccttctgcaatcagcgaagccgcaatcgccttcccgatgcctgacgtagatcccgtcacaagcgccgtcttccctttcaactgcaagtccatcatccattcctccctatcgcaagtctcttcttatatatggacagaaatcgaaagcctgaaaccttccgtccctattatcggatagaaaaatggatgaggggaagtacgcactttttagtgcctgtccgttgtcccggctgacggctgatcgatttgaatgacaaaccgattctctaactcttcctgagcctcttgaaacagctccaagacatcatcagcatccgaacccaatgccatttgactggcctcaaaattcttccacaccaaagtcagcggatattcgatccatcctgtcaggcaatcccataaggcgttcagattttcaccataaaagtccgggaaatctaattgatcttttaagattcggtgtaatgcttctatgcttgtaacatcttttccgtctatgatgacgactatcattcacatggactccttttttcttcgaattatatttagcaggatacaccttgatccattaccttcgacccgttattataactcacctcacacttgttaaggagaaattaatattctagttatttactgtattatttattattggtagaatttaattgaatcttatgaggagggttatagatgaaaaaatcttttgtttttctattatcgctagtgcttttatttagcatttttcctattagcactttagccaccgtgaaaacgtcagaagatgacacgataactgtacctggaaaagatgtaaaaaacactgcagtattagttgatgctatcaatgaattagatgaaaaattggatatgaaaaatctatcatctaattctccagaagatataagtcaactgagtttagcagcaaaaacgctgtatgatactattgtaaattatgaaaatcaaacatctgcttctttgacaggcactgacgcgttgatcatattcaaagagtatattgacgagttaaatagaagtgaagttattaaacctgttgaacacattgtaacaacaatgggagttataaactataaagaatataaaattagcaactcacaaataaaacaattgagtgctgctgttggaattaatagtggattttggggtacagctacagctatagctaaaatttttgctaaaagcccaactgcacttacattaatgttaggtgcggtaccgcttttaggtatgggtactataaatgcctgcaattctaaaggtaaaggcattattattacaaaaatgggttcaggagcaacgaatacatatagttgtagatctcaataaaaaagtgtgagctttcgctcacacttttttattttttatttttctgatacattttgatataaattcactaacaaaaaaaactattaagcctgatattaataacaaaagtgaatttatctttaaacccttgttaaaaaaatcaaggatactatttatcaataaaaaacctgaccaatagatgaataaagaatagaaagctatattagtgctcttttcatccgtatttctactagttttaaaaaacaatgatctgccctccctattcttgaatcttttcaatccttactataaaatttttcaatgctcatcaaaaatacttattggtggttaagtgcttaatctttcgtttaggttggtacattgagccttcttcattttactcatgtcgtcacctcccataaaacaatgataacatgaattaattctagtttatattgtatgtaattcccgaaatagctaatactcttcactaacttcaagtataaaccgaaaaatttaaacaatttcatttaaaatctaaacagaagtccatgtacgagactgaagaaaatactccgcaattcgatccctatctttcatttcattctgaaaacaattaaaacaaagagcatagtaattctgttggctttatctctattctttactgtatttcctggacagcttatttgccaaaattatacaaacggataatacaaaataataggataaagcaaaagcagcacatcttttagattatcctttttaagtattgaatgagtagtaagagaaattaaaatgaacaggcaggaatttagataggaggaggtatggcattaacacgaaagccatcttcctttcagcacaaagggagaaaacgaagaattttaaaaagtgttgccaaaatgttaccgcagtgccatcgaaagctttgaaagccttgataacactgcggtttcggcgttatgtatggagacggtgggagtcgaacccacgtccagaaacatcgattacttaagcgtctacgagcgtagcctgcatatttcgtgtttcactcgtcttcatgcctgcgggcgggccttccgagagctagtctgtcagtctcttcttacgttctcagacgggaacgcaagcgtagcctacttggatgtgctcttcacggacacataggcaatgtcaggaagagctcgctgcgtttattaggcagctagtgctaagttttggttaaaacttttagttttgccagttatatttaggtgcgtgttaacgagatcgcctctcggctcgcagctcaagctcgatccatccctgtcgaatccgtaacgtccccttgttaagggtatacgggagatctatcaagctcttgctcaactggctgtactgttattataccatgatcacaggcaaattcaattgggaatatcttcaataaacagcctgtgaatctgatgtgtgaacagtatagcacagggctgtcatcacatcaaggctcaggcatcagaagcctttttgtctgtctctgaacgctctttcgatttctcttttggcgtcttttcgttttaaatcatcacgtttatcgtatgttttcttcccttttccgaggccgattaacactttggcgaagccatttttcaagtacagcttcagcggcacgagggaatagcctttctctttcgtcaggccgatcagcttattgatttctttccggtgcatcaaaagctttctcgtccggagcgggtcgtggttatagcggtttccctgctcgtacgggctgatgtgcatgttgtggaggaacacttcgccgcgctcgattttcgcaaaggaatccttcatgtttacgcggccggcgcggatggacttaatctccgttccctgcagcacgatgcctgtttcataggtttcttctataaagtaatcatggtttgcttttttgttttgcgataatactttgcctgatccttttggcatgccttatcctcctctctccgcaaaaaccgttcatgtgtgcgatacgctttattttagcaaatggatcgttccgcgacaatgaaaatgcggcttgcgaaagaaagcaaacagagcattatgccccatttgcttttcgcatttacttcttctttttgcgtttttgtttcggcgcgttttggaaaccgcgttttttctttttcttcttcggttttgtaaaccattcccctttttcctccgatttcggcggtgaagccggggtattgctgtttaacacgcgtttccgcgccggtctgcctcgttttctgcggtcgcctgttgtttctctcggacggcgggtgcctttcatgccgacaatttcaaagtcgatgtttctctcatctttattgacgtcgacgactttgaccgtgatttcgtctccgatgcggtaaacgttgcccgtgcgttcaccgatcatggcgaaatgctgctcgtcaaaacggtaataatcatccgtcataaagctgacgtgcacaagcccttcaatcgtattcggcaactcgacgaacattccgaaattcgtgacggaactgatcatgccgtcaaattcctcgccgattttatcaagcatatattccgcttttttcagatcgtccgtttcccgctcggcgtcaacggcgcgccgttccatcgttgacgtatgatcagcgatttccggaaggcgttcggcccacttttcctgagttgcttcgtccgattgtccgttgatcaaatacgttctgatcagcctgtgaacgattaagtcaggatatcggcggatcggcgatgtgaagtgcgtataaaattcagtcgccagcccgaaatggcccaggctttgcgggtcgtatttcgcctgcttcatggaacggagcatgacggttgaaatcaccgtttcttccggacggtcccgcacttcatcaagaatgctttgcagcgcgcgcggatgaatgtctccggctttccctttgacgatataaccgaatgtcgtcacgaactccagaaacttttgcagtttttcggcgttcggctcttcgtgaatccggtaaataaacggcacgttcatccaatggaagtgttcggccaccgtttcgtttgccacaagcatgaattcttcgatcagcttttccgctactgagcgctctctgatgacgacgtctcttacggcgccttcctcatcgacgagcaccttcgcctctttaaaatcaaaatccacggcgccgcggtccatccgtttcgcccggagaatttccgccagacgttccatgtctttaaacatcgggacgagcggctcatatctttctttcagctcggcgtcgtcttctgtgaggatccggttgacatctgaataggtcattcgttccgtcgttttaatgacgctttggaagatctcgtgttccgtcacctgtccctgctggttgattgtcatttcgcaggaaagcgtcagccggtcgaccttcggatttaaagaacagattccgttagacagtctgtgcgggatcatcggaatgacccggtcaaccaagtacacgcttgtccctctttccagcgcttctttgtcaatcggggaattctccgtgacgtaatggctgacgtcggcaatatgaacgccgagcttgtagctgccgttatcaagctttgtcacggtgacggcgtcatccagatccttcgcatcggcgccgtcaatggtgacaatgacctgatcgcggagatcacggcggtctttgatgtctttttcatcgatggtatcgggcgtgcttgttgcctgctccatcgcttcagccggaaaatctcccggcaggccgtgcttatggatgatggataaaatatcgatgcccggatcatttttatggccgagtatttcaacgatttccccttcggcgttcattctgccttcaggatagcttgtcagtttgacgacgactttatggccttccgcagcgccgttattggcatgtttcggaataaaaatatcactcgtgattttcttatcatccgggatgacaaagccgaagcttttcgtttctgtgtatgtgcccacgacgcggtcgatgcttctttccaggatgcggatgaccgtgccttcctgtctcgatccgcttgactgggaattgagccgcaccatgacgatatcgccgttcatggccgtattcagctcgttcggcggaataaacacgtcgcttaaagaggtatcctccggcagcagaaacgcgaagcccttcgcatgcgcggaaatttttccttttactaaattcattttttccggaagcccgtagcggttgcttctggtgcggacgatctgtcccgtctcctcaagcgccaccagcgcttttaccagctctttaaattcatcggcttccttgatgttcagcatctcctcgagttcctgaatggtaaggggcttgtacgcctcttccttcataaacgcgagaagacggtccataaacgcttctttttccattattcgacctcctgtttgttaccaatcgagtttctctaaaaattcgtacacatcctgatgaacgaggtcccgttctttatcgagcgtaatgacatggcctgattcttcataccatttcagctgtttgtcgtccgtttccacctcgttgaaaatgatgttcgcactttctgtattaatcatatggtcatgccgtgcctgaaccacaaatgtcggggaatagatcatgtcgacgtttttgcgcacatcggcaatcagctcctggagcgatttgagcgtattcatcggcgttttttcaaactccttcatttccttttcaatctgctccggctgttttccttcgaattttttataattgcgcgcgtaggagagaactccttcgtacataacctcttcacttttaatgtgcatcggcgcacacataggaacaattccctttatgggtacagtgtaacccaatttcaatgaaaaaaccccgccaagcgacagtccgcacgccgcaatgttttcatagccttcagaccgtaaatactcataaccgtccatgacgtctttccaccaatcttcaggtcccgtatgtaccagctcttccggcggaacaccgtgccctttatattgaggcgcgtgacaagtgtagccgcgctcattcaagtagcggccgagcattctgacgtctgccgtatttcccgtaaatccgtgcagcagaagcaccgctttgtctccgcctttaaatgtaaatggttttggtgtcacaattttcatgctcataaccccttttttgcacattcaatttagttttccacagttttgcgagaaacaaacgccgtctctcaacaagaaaaaggcctgatattaaatcagaccttatacaaacattgccttatacgatatacgctagcgaaatcgtcaacacgaaaaacaagactgccagcacaacggttgtgcggtgaagaatcagatcaaggccccttgctttctgttttccgaaaagctgctccgccccgcctgaaattgcacccgataaaccggcgcttttgctggtttgaagcaatacgacaataataagtgcaatactgacgataaccaataaggtaatcaataatgtgtgcatcccatacacctccagactgactggcctacattgcttctattttacatgaaaaacaaaggcatgtcacgccgtatcggtgcacatcatgtcagaaaaacggaaatgcgtttgaatcttccatcatcattgacttttgtcaacaaagtcgtagtaaaaaagatcttcaaatttcatgtcaaagtaatagagcatttttccgatgaccagctggcccggcctccgctctccattcagtacacggctcagtgtggcgggagatattccgatctccagggcgagctggtttaacgagtagtcattattgaccatatactgcagcacataatctcttctgatctgtatcttttcgaccactttcttcaccttccgttctgtcaaatactttctttcttatacataagatacggcttttgttaacttttgtcaatacttttccagcctggctattccctttagtcaataaacatactagaatataaatagaccgcgggagggggagagactgtggaaagcttcgggaaacaattgcggacattacgggaaaaaaggcatctgacagtgaatcagctggcaacgtattcaggcgtcagcgccgcgggaatctcgcggattgaaaacggcaaacgcggggtggctctaatcgtctttcagttattgaacggacagcagcgatttagcgaaattgaagcggcgcttccgaatttaagcggaagagtcttgtcagaacgtctgaaagaacttgaaacagaaggtgtcatcaaacgggatgttatccccgaaacgcctgtccgcattgagtactctttaacggaaaaaggctgcgcattagcccctattttagaggaaatttccaagtggtcttcaacatggattgatccttcctgataaactcttttccgcataagcggctgatctctcaaacggacagccgtttttatttttgcttttcttatacagaaaaacaagccctcaggcgtgcagggcttgtttttgtctgacgccttccagcggaattcgaatctccgcccgggctcctccagactcctgattttcaagtattaattcgccgtgatgaagatgtacgacgtgatgggcgaatgtaagccccatgccgtgatgtcccgccgaatgtctgcttttatcctccgtgtaaaaaagctgtgtcgctcttttcagcgcttccggcgagaacccgcttccgctgtcggatacggcaagatggagggcggaatcggtgcacaggacgtccacacggatttcccctccttccggcgtatagtcgacggcatttgccgcgatattcatgaccgccctgtggagcagctcatgatcgatcggcgcttctattcggtcaattccccgttcgctaaggacgagatcaatctgcttcggccccgcaagcgccgccgcatcacgatatatgttttgaatccactctttgaggtcggtatattcaacatgaacggcaactgcctcctccgctttggaaagctggatcagctgtccgacataatgctcgattttgtttccggcatccaggatatactgcgcatattccgcctgctcctcatcaggttctgttaactgaagcagctcggcatttcctttaataatcgttgccggaattttaatatcatgcgcaagcgcgccgatttgttctttctttatccgctccgcctcccactgcgccgccagagatgcctgaagcgcgtctttcattttcagcagagagtcaatgacatcgtcaaattcctttatacgcgacctttttggattgatatttaaattctgtttttgaatgcttgccgtaatggagctgagtgtgctgaaatgccgtctcagctgattggcgaaacgcgtcgtcacgataaaaacggtcaaaagaagcaaagtgatcagaatcgtaagacccgtccattcataattcggcagatagcgccttaacagcggcgactgaaattccgacctgagtgaatattggagaacgccgtattcatctttccgatttatcaccatgaatcctttttgagcataattaaaatacggctgatgctgaatcttttttctggcgttggccgcatcttgttccgtcatcgttccttttgtcatccgctttgtttttttatcaaaaacggcgtatgtcataccgtcgggaatcatgtcttctgttatcttttccgccgatttcaggcggggcttgatctgttccgcctcatgctcgctgtagtttgcgggcaggatcgctccggcattcatggcaatggcatttaaggcgacgcataatgccgccacccccatcgtgctcagacacaaagtgatggtaaatttgacaagctctttgcggatgctggattttccttttgctattcccatttgtatccgacaccccacaccgttttgatcggatcagccccgtgttctttacattttttccggatggttctgataaactccgtaatggttgaatagagcgcatcgccgtccaagccgtacacttcctcgtaaatctgctcccgtgagaatgttctgtttttatgctgtgccagaaattcaacgattttatattcgtttttcgtaagaggcagtttccggtcatccatccatacttctttactgtcaaaatcaaacatgaagcctgatatcagccgtttcgtctgatgcttttcccgccgttcccttctgacatgcgcgtttacccttgccatcaattcctgtacgccgaacggctttgtgatgtaatcatcagcgcctgtcatgaggcctttcacaatggattcttcgtcagactttgccgttaaaaacaggatcgggctgtccaccagcggccgaatccgccggcagagttcaatcccgtccgttccgggcatcatgacatcaagaagaatcaaatcgtagccttgaaaaaaatccaatgactgatcttccgctttttccagaatcgttactgtatgctgatcacgctgtaaaatgtttctgatcagaacgagaatatctttttcatcatcaattgctaaaatgtttgccaccggccgaatcgctccttgcctttattcatatgaacgccgcccttcccatcttctgcaccaatagaggccggccagacataatatcactatagaaaaatataacattatttctccgaatctcatatcgtatcttacataagggaggaactcttttttgactttgtcaaaatgcagcagtcctgcaaggcctgaaagccgcacgctccatgcccacgggaaaaaacgccagatgatatcgccaagtcccgtattcatgagcgccgccattaataatcccgcaccccctaaaagcccggacggtcccatgccgtactgtatgccgacaaaaaaagaaatcatataaagcggaatactgccggcaatcagccacgcccctccttttaaaaagagaagatacggaaggtcattgatgtgaagaacaaatttcatccccgccaaataaagacagatggcaagacctatcgataacacattcaagagcagcagaagaagcagcttgcccgcaaaactgacgattttcgaatgcggaaccgccagcatcatctgaaaatggcccgcctgttcctcgacggaggcagacatgccgcagacaatactgatgattagagggtataaaacagcaatcgcgctgaaaaacacactgtacagcatataaggctcctgaacccttccatacatatacaacaggaaaaatcccgcgcataaaaccggggccgcagcatgcatccatatgagcggcgtgcgcttcatttttaatacatcggcccacatatatcgtaaaagcacggtcatgaccggtttcccccttttgaaaaagacactgcggaaatcaaacttattgcgataaaagaaaggatagaaagaataatagccggaaagatcacgtttccgtttaataagccgctgtctgcgggaagcggaattccgttcggatggatcccgagaatcggtgacatcagccggactgaccagctccatgggctcagccaccacaatgaaccggacgccggcacaatacccaaaacaaaagcggcgatcatattcacgagaatgactgccgtaaatccgaactgcctggcaatccataagcacaatggaatttcccaaagcgtcgtcagccataaaaggaagcctgcttcaacgcctttcagctgcagcgcagcaattgccggaaatacaaggccaagtaaaaacatgatgatgaaaaagacgatttgcgacaggagtgaatacagcgcgatcaagcttatttttgagagccatatgctttttaaatctgccggcaatgagtacaccgcgcggtcattcgcagattttttctcttttttaacagataaaccgcacattagagcaatcatgagcggcatgaaaataaccgcccaccaattgaacgtgcccgtcataaaataagccgtattcagcagaaaagaaaaagccgtgttcagaagcgggatcagaatgatcagctttctgataaatgttcttttagatgtaagatgttccgcctgcatgtactgaatcatttcccagtccccgctttctcccgtgttgatttgacaacctccagaaacagccgctccagatcgtcttcccggctgatttctccctgatatcctaaaacgccgtcactgatgattccgatatggtctgcgatctgctcgacttctgataacaggtggcttgataaaataaccgtcattccctgtccgggcagggagcggataaattcccgcaaatcctgaatccccatcgggtccaatccgtttgtcggctcatcaagaattaagagcgacggacggtttaataatgctaacgcaatgccgagacgctgtttcattcccatggaaaattgtccggcgcgcttttttccggttcccgttaatcccgtgatttccagcacttccgcaattcttgaatcaggcagtccgagcatcacgcagcggactttcagattttcagcggctgtcaggttgctgtaaagcggcggcgcttcaatcagggaaccgatgcttttcaaatcttcgcgcttccatgtatgtccgtcgaacagaacctcgccggatgtttgctgcagcatgccggtcaatattttgagagtcgtcgattttcccgcgccgttcggaccgagcaggccgtatatactgttgcgtttaaccgatagagacacatcagccactgcctgttgtctgccgaatgatttttgcagccgtctcgtttctaagatgttgctcatatgattacccctctgctttgttatttgatatgtaagactttacagcgcagttatcaaaatttaatcaagaaatcaaaaaaagcatccttcacgcggaagaatgctttttttcatgaggctgagcgtacgatcagctttcttttttgttttttcaccgggcttagggctcgctccagccacgccatcagcaggtctgcggccaccgccatcagcgcggtcgggatggcgcccgccagaataatggcggttccgtttgtcgcgttcgatcctctgacgatcatatcgccgaggccgcccgccccgacgaaggtgccgatcgccgtgatgccgatggcaatgacgagcgccgttcggagacccgccataatgacggaaagcgcaagcggcagctccaccatacgaaggatttggtatttcgtcatgcccatcgcttttcccgactcgaaataagcgtgctcgatattgataatgcctgtgtgcgtatttctgagaatcggcagcagtgaatacaaaaacaaagccgtgatgaccgtattggcgccgagtcccatgacaagcatcaggacggcgagcatcgcaagcgccggaacggtttgaatcacgttcgccacagcaaacacccagccggcgagacgcccgtgcctggctgtcacaattccggccggaatggcgaaagcggcggcgaaaacgacgccgtacgccgacatgagaaagtgccgccagcactcatacagaacatagctgccgttttgagcgtaatacgtaaacagctctttcatcgtgtccatccgcacatctcctttccgttattcaaagtaatgatgtttttctaaatattccttggccacgacggacggctcttttaatcggccgtcaacttcgtaattcattttctgcatcatctttgtatcaatcgcgccgatcatttgattgatcacgccctccagttcgggatgctcttttaatacatgatccggaacgacgggtgaacagtcatacggaggaaagaaacgcttatcatccttcagcgttttcagtccgtaagcgatgattcttccgtcggtggaataagcgagcgcgatatccatctttctgcttttcagcgcgtcgtatacgaggccgatctgcattggatacgtgccttcaaatgacattccgtatgttttcataaaatcctgatacccgttgcctctcagcttcatccaatagttatctacgccgaatttcagatgagacgcttcttttttgacatcggataccgtttctaaatgatacttgcgggcaagctgtccggaaacggtaaagacgtatgtattatcaaagccgtaagaatcaaaccatttcatgtcatatctgttttgaaattcacgctgaacgagccgcagcgctttgtccgggtctttttccggctccatgcgaagcgtcccggtcagcgcgtctcctgtatagcgcgtcgcggcgatatcaatgtcaccgtttatcaaggattgctgctgtacggcattggagccgagatttttaataaccgttgtcttcaacccgctgtgatgttcgatcatctgtccgagcatgcttgcgatgatttccgattcggtcatgctttgcgcgccgattttaatggtgtcctccgatgcggcgctcaatcccgggagcgagcatccgccaaggagcagcatgccgagacaggcgattgcgagcagccgttttttgcatctattccccatgagagacctcctccttatgaagcgtcctttatgcttttcagcccgtcaggcgtgactttccgttctgtcatccccaacatgtaatcgacggcggccgccagcatcgtgaccggaacggcgcctgcgataatatactccggctgataaaggttcaagccgataaaaatgtaatctcccagcccgcctccgccgataaaggaggcgagtgtcgcccagccgattaaataaatcgaagacgttctgatgcccgccatgatgaccggagcggcaagcggaagctctacaagcctgatctgctcccataccgtcatgccgattccttttcccgattccagaagatgccgattgacgccgagaatccccgtatacgtgtttctgagaatcggcagcatggaatagaaaaacagcgccgcaacggccgggacctttcctacgcctaaaagcggaataaaaaacgcaagaatggcaagactcggcaaggtttgaatgatgttgacgatgccgatgacggcgccggctcctcttttcattctcgtcagcaggacgccgagcggaacggcggcgagaatgcccgccatgacggcgattaatgagatgtacagatgctcccatgttttataaagcatctctccgccatttgcctgtaaaaattgcacggtctgattcatatcaatggaagcctcctcatgacatcaccgcgagctgattctcttctccccagatggagtcatagacgatgtcaacgaggcttgcccttgtcacgattcccgttagccggccgtcctcatcaaggaccggcacaaatttcatgcctctttttaaaatcttatggacggcgtcgcgaagcagagtgccgcttctgaccgtgtacagatcccgttcaagcacttccgcgacggttaccgcttgtcttcgtttgcggtcaatcatctccacatcgacataaccttggagaacgttcttttcatcaatgacgagcagcgaatccacccgctcggcacgcatcagctgaatggcggctgacagtgttttctcaggtgttaccgtcacgggatcgggattcatgatctgctccacccgttcaatatcagggctggatgattgaatcagccgttccttgccgataaactcctcaacaaattcattcgccggaaatctgagaatctcatcaggcgttccggcctggacgatttctcccgctttcagaatgacgattctgtccgcaagcttgatggcttcgtccatatcatgggtaacaaatacgatggttttatgtaaggttttttgcagttttttaaattcttcctgaagggaatctctcgtaatcgggtcaagcgccccgaacggttcatccattaagataagcggcggctctgcggcaagtgcccgtaatacacctattcgctgctgctgtcctccgctcagttcatgagggtaacggtctaaatattcaggccccatatcaacgagctttaaaagctctcgcgcccgttccttccgtttttcggcaggatgctttaaaagcttcggaacgagcgtaatgttctgctgaatggtcatatgcggaaacagcccgatctgctggatgacatagccgatgcttcttctgagttccaccgggtcttgttccataatgtttcggccctctatcaggattctgccttctgtcggttcaattaagcggttgatcattttcatcgtcgtcgttttgccgcagccgctcggtccgataaaacaaataaattcgcctttggcgatattcaggttgatgctgttgacggcttttttcccgcctttatacgttttcgagacattttctaatgtcagcaaacactcacacctccgatattaaatttgttcaaatcgttaaattcaaatttaacttttcagacaattgaacgtttcccattataaattaaactttgtaaattaaaaagtttacaatttgtccatattatatataaaggttgtgtaagcactgatttacccgtattgaccggcaaagttcttcttattgctccgaattactgccaaattctctcggaagagcatttccgccggtttaaaaatgtggtatattgacatcggaattgctgactgaaaggattgaaactgttggagaaagatccgttacacgtaatcgaacaagctgaagatcatttgatagaacgaatcgctgaaaatatgcatacattcggaatgccggcgacggtggggcgcattttaggcattatttatatgaaccgcaagccgatgaccttaactgaattatcagaagcgaccggcatgagcaaaacgagaatgagccaggcggtccgtgaaatgcttgacgtcaatctggcggaaaaagtgtttgaaaaaggcgtccgcaaagatttatacgacgtcgagcaggattattatcaaacctttattacgctgtttacggccacatggagcaaggtcgtcagcaaaaataaaatgatgcataaaaagctgaaccgcgaactgacggccgtccttgaaaacggcgtgccggaagaagctgaggaaaaaatcaacgaactgctgaaagaattaaaggattggcttgattactacaactggatcagccgtctgatcgagttttttgaaagcgaagaaatattcaagcatgttccgaagccataagaaaaaaacgccctgacccgcaaggcgtttttttcatgccgcattcggcgctttggttcgttttttctttctcaccggactcagcgcccgctccagccatgccatcacaagatctgcaataacggccatcagcgctgtcgggatggcgccggctaaaataatcgcggttccgttcgtggcgtttgagcccctgacaatgatgtcaccgagtccgcccgcgccgacaaacgtaccgattgccgtaatgccgatcgcgataacgagcgccgtccgcagccccgccatgatgacagaaagcgcaagcggcagctccaccatgcggagcacctgaaatttggtcatgcccatcgcttttcccgattcaagataagcatgttcaatgctggcgattccggtgtacgtattccggatgatcggaagaagcgaatataaaaacagcgacaaaatcaccgtattggcgccgagccccatgacgagcatcagcaccgcgagcatcgcaagcgccggcacggtctgaatcacgtttgtcaccgcgaatatccagccgcttaatgttctgtatctggcaatgaagatgccgagcggaatcccaacgatcgccgcaaataaaacgccgtataccgacatgagaaaatggcggtaaaactcctgaagcacatagacgccgttttgagaataataagtgccgagctgctgcagcacttccatttgccccacctcatttcttattcaaaataatgatgtttctccagaaattctttagcgacgacggacggttctttcagcttgccgtccacctcgtaattcaattcctgcatcgtttccgtatcgattttgccgatcagtttattcacaatgcccttcagttcaggatgctgcttcagcacgctgtcgggaatgaccggcgaacagtcatacggcgggaaaaactgcttgtcgtcttttaaaattttcagatcgtacgctttaatccgtccgtccgttgaataagcgaggacggcgtccattttcccgtttttcacggcatcgtatacaagtccgatctgcatcggataggttgtgccgaattcatagccgtacgtgtcggtgaagcccttatagccgtcgccttttcttttcagccacgcattgtctacaccgagcttaaattgatccgcatacttcttaatatcggatactttgtctaaatggtctttttccgcaagctctttcgtgacggtaaaagcgtatgtgttctcaaatccgtaagaatcaaaccatttgtaatggaagcgcttctcaaattccttctggacgatagataatgcttttttcgggtctttttccgcttccatgccgagggtgctcgttaaatccgttcccgagtagcgcgtcgcggcaatatcgatttcaccgccgagcatcgcctgctgctggacatagttcgatccgaggtttttaattaatgccgtattcaagtctgtattgtgctcaatcatctgtgcaatcatattggcgataatttctgattccgtcatgctttgcgccccgattttaatcgtatcatcggaagccccgctcaggccgggaagggaacagccgcccagaagcagagcagctgacagcgccagtgcgcacatccatctcttttggtttcttttcaaaacagccaactccttatgatacttccttcagtcctttcagccctttcggcgtcaccttccgttccgtcgccgccagcagataatcaatgataatggctaaaatggtgacgggcacggcgccgccgataatatattcaggctgatagagattcaggccgataaaaatatagtctccgagcccgccgcccccgataaaggaagcaagcgtcgcccagccgatcagataaatggtggatgtgcggatgcccgccatgatcaccggaaccgcaagcggcagttccacaagcctgatctgctcccagaccgtcatcccgatgccttttcccgattccagcagatttttgtttacgccttgaatgccggtatacgtgtttcggagaatcggcagcaccgaatagaaaaacagcgcgacgatcgcgggcacctttcccacgcctaacagcgggataaaaaacgccagtatcgcgagactcggcaaggtctgcacaatgttgacggcgccgatgacggcgcctgcgccctttttcattctcgtcagcgccactccgagcggaacggcgacgacaatgcctaatatgacggcgatgatcgaaatgtataaatgctcccacgttttatataacagttctccgccgttcgtctgcaaaaacttgatcatttcattcattgtaagcgttcctccccttgtcagcctgtcaccagctggtcttcctcgccccagattgaatcgtaaacgatgtcgacaaggctcgctcgcgtgacaattccgactaaatgcctttgttcatcaacgacgggtacatatttcattccgcgctttaaaattttgcgtacggtatcacgcagcagtgtcccctgctcgaccgtatacagatcagagcggagcacgtcgccgacgaggctcgcttttttccggttctgatcaatgatctcgacatcgacatacccttgcagcacattcaggtcatcaacgacaagcagggaatcgacacggtgctcccgcatcacttggatcgcctgcgaaagcgttttgtccgccgtaacggtgacaggctttttgttcatcatctgctcgacgcgctcaatgtccggtcttgattgcaataaccgttctttgccgataaattcttcgacaaactcattagccggattccggagaatgtcatcaggagtgccggcctgaacgatctctcccgcttttaaaatgacgatccggtcagccagctttattgcttcatccatatcgtgggttacaaacacaattgttttattcaatgttctttgcagttttttgaattcttcctgaagggaatcccgtgtaatcgggtcaagcgctccgaacggttcatccataagaataagaggcggttccgctgcaagggcgcgcagcacgccgattctctgctgctgtccgccgctcagctcgtgaggatagcggtctaaatattccgggcccatatcgacgagcttcaaaagctcccgcgcccgttccttccgcttttgttccggccatttcagcagtttcggcacgagggaaatgttctgctgaatggtcatatgagggaaaagtccgatctgctgaatgacgtagccgattttccgtctcagctccaccgggtcctgctccataatgttttcgccatcgataaaaatctttccggatgacggctcaatcagtctgttaatcattttcatcgtcgtcgtttttccgcagccgctcggcccgataaaacaaataaactcgcctttttcgatgtttaaatcaatgctgctgacagctttttttccgcctttatagactttcgatacattttctaatctcagcaatccgtgcacctccgaagggttccgttatttttctgaaaagtataatctttattataagatgaaatttgtaaaataaaaagtttacaatgtgttgaaattatatacaatatacgtattttttcatgttatcccgctgacaatgcggatgttcttacaatcgctcccgatagctcgcatatcctgccgcatcatctttttcatcaactgtaaaaaatatgatatattgtcagcatgaaaagccagtgaagggatgatcagccgtggaaaaaaacgctcttgatatcatcgggcatgctgaagagcatctcattgagagaatcgccgagaatatgcatacattcggaatgccggccacacttggtcgtgtgctcggtattatttatatgaaccgcaagccgatgacgttaaatgagctgtcagaggcgaccgggatgagcaaaacgaggatgagccaggtggtccgtgaaatgactgatgccaatctggcggaaaaagtgtttgaaaaaggcgttcgcaaagacctttacgacgtggagcgtgattattaccagacgtttatctccctgtttacggcaaattggacaagggcggtcagcaaaaacaaaatgctctataaaaagctgaaccgcgagctgactgagcttctggaatcggaaaatctcagtcccgatattgaagaaaaagcccgtcagcttttggatgaactgacggattggctccattattatgactggctgagccgtttgatagaattttttgagagtgaagaagtgtttcagcatgtgccgaaaatagaaaaaagcagcacccgaagataaccgggcgctgcttttttaagtcaggaaaccaatatcgggaacatgcctttcagaccggcgccgatcatgccgatcgccaccaccgccaagatcagccccatcagtcgggtaatgacgttcatttcggttttcccgagcttattgctgatgaaagatgaatagtgaaagaagatgaacgtcatcgcgatgacggccgcaatgccgataagcacgctaatgtaatggatgatgccgccatggccggccgacagactcatcaccgtcgcgatcgtaccgggaccggcgataatcggaatcgacaaaggcgtcacggaaatatccgctttctccttgctttcccccttctcttcatgatgaagggactgtacatgtgattgtttcgcgttcaaaagattataagcgatgccgaaaataaaaataccgcctgcgatacgcaaggcatgaatattaatgtcgaacagtttaaagatcagatggccgaagattaaaaatgccgccaagatgataaacgacagcacggacgccttgcgtgcgatcgctgtccgttctttctccgggtagccctctgtcagtgaaagaaaaatcggcacgtttccgatggggttggacactgcaaacagggaaatgaagacatgaatgataaatgaaaacatgcgtacctccttatggcttgccattattgagttatgttttgttctccgctgtttcttatgcatgatttttaccccggggtctgctttttataacctcagccggacgatccggaaaacagaaaaaaccgtccttgtaaggatggttttttctgtttgctatctccataagccttttccgaatttcaacagccgataaagcattttcaatttttttagcatgcgttaatttcctttttcactctggttcaatgcgccgagagacatgatatctgtcagctccaataaaattctaccataatgggtactttttctctattatcaattcatagagaaggtgatttatatatctttagaaaactccgttacatccgtcctattttcttttataatgtaaatattgaacaaaatccctatattacttgtaaaaggagttttagaatgtattgttctcaatgcggccatcatactgatggcggaaaattttgtgaaaagtgcggtgcgccccagcccgggcagggaggcgcaggccaaacacagggtcaggccgctcaggccggcgccgcggctaagcaggcatcaaagcaatttgccttattcgtgcttgatgtgttaaagagaccgtatcaaacatgtaaaacgacaggcggcgaacagcttgtcagcagcatcatcaacatggtgcttttctgcctggtgacgccgattatgttttatattctcttatcggacggctttcgtgatgtcagttttaccgcggttgtgatcaaaccggcgcttacctttgcattatgcgtattctgcctgtatctcttgatttttatcgctttgaaggccggcggcgcgcaggtgtcatttaaagattcgctgtccagattcggagcatttttgattccgtttacagctattttgcttcttgccctcatttttatgctgcttcatacaaccgtttgctttaccattctggctgtcggtcttttaggagcggcgtttgccgtgcctccgctcatgctggcgagctatcagcatcagctcacggctaaagcggatatcatttattctgttatcgtcatctatttgatcatttgcgtaacgtttcaattcacgatcaagcattatatgaaagaactcatgaattatttcttcttttaaaaacggaaaccccgccgcctgattggcgcggggtttttttattgaatggatgttaaataaattcttccgtctttgacaacgccgccatacgtccaattgtatgttctgagcttcggactgccgccggctttcgtaatataaaactcctcgtacgtatgaatcgtcagatgagagcctttctgtgaaaagcttttgacattcacttcattaaatacttcggtcgtgccctcgctgtgcagttttttgaccagtttctgctgatcagcatacaaagggcttccctcttctaaattgcccgccatgatggcaaaattgttaaggctgacggcgcttgattgatttgtcaggtaatcagtcataaacgatgtgacttgctcgtttgtcacgctgcctgaagctgtatttcctttggaagatgcccatgcggatgtataggttttcggctggtcgttttttattttttttacattggtcccagaagaatctgaggcagggtcagctttttcgaaaacccattttttatgttttgtatcatatgagagtacataatgaaagctcggctcagcctcttccatatcaggcttcgtattcccgtcgaaataagcagactcatgaagctctttacccgtaacagttgcttgccagcggccgttctcttgagaaatcgcaaatgaatccagatcaaagcttgtctctttatactgatctttcaaaaaggtgccggaactcttcatgccggataccacttctttcgtctgctctttccaggcggaaccagcctcggtcatctgatcggtatttccgtctgccatcgcttttgtatactgcttcgttgttttgacaatcgtgtccatgattgtttgttgtgtatcttgatccgggataagcgttaagtccacatcagtactgttgatcggaacatcggcagttttcatttttccccaaggaaaatcagcctccacggcggctgtcatggaaccgtcagttaagagcggaccgtatgtaacggatttaaacggatctttatggacggacttgccgtttatcagcagatcgcctttcgcgtttttgaagctgtctgccggagtgaacgtcacatcctcggcgtctaacggcaggtcaaaatcaacattccggctgccggccgcctctgcctcttgctttttgacaacgtcaaccgtgtcatttttaagcttggcttccgccgtgtagacaccgggtgcatacgggccgaagatttgggtttcatcggcttttttgaccgtccctgttttctcgctgttgatataaagatcggcgcctttataattgctggtgacgcggaaataaaccggatcgactttcagttcgtaatggtcaaacaatagaagggttttaccctcttttttgacgtataccgcatctttttctgatgaattgccgcgaagcgttgccagcagttcatcgtgtttctttgcgtatgcaaggagcggtttgacattggtctcattcagcttcagttttttgtctgaaggagtgagcagggctgcgagctttttcgtgtccccgtcatgaaccgcctgttcgaattgatccgtgagccttttttcagatgtcagccaggctccggttttatatgcggcaatcaataagatcagcgctgcggcgatgcctccccataggaagagcgtttttttagggatcggctttctcggctgtgatgcggattcagccgcctgccgctccagccggcttcctttcccgatcggctttccgcattctttacagaaatgcgcctcttcattattctgtcggccgcaatatttacaaaaaaacatgactttcctcctattcaatctgcaaaacttgtataacttttcctatgtttcatattttataataaagtagaatgattttggagttattttgaaaaaatagctgccgatcacaatgaaggaggagaaacggacatgcaaaaactgagcatccgaaaagcggcagagcgggatgaagcgctgtatgaactattgctgctggccgatccgtcgaaagagattgtcgatgattatcttgtaagaggagaatgctatacggcttggacgtcagacgagcttgcaggggtttacgtcttattgcaaacaaggccgaaaacgatagaaatcgtaaacatcgcggtaaaagaatcgctgcagaacaggggattcggaaaacagctggtgcgggatgccattgaaaaagcgagagaaacgggagctgacacgattgaaatcggcaccggaaattccagtattcatcagctgtcactctatcaaaaatgcggattccgcattcaggctgtcgaccatgatttttttatcagacattatgatgaagacatttttgaaaacggcattcaatgccgggatatgatacggctttatttggatttatgataaaagggcgccggctgacatcggcgccccttcgtttaacattcagacggattgatccgcttgtttctctgtatttctttgactccctgctctgactgaaaaaacagcaaaaacgatcgtaagggtcagtccgaccgccgcaaaaatataatccgcattcatcaacagcagaagccctgtgtagacagcggccgacagcggttcacccattttgacaatggaaaaaatcagtgcaaagacccttccgaaatatgcggccggaaccgtcttttggaaatacagcaccgtttgcacatcaatatacgagatgatgatgccgagcaccaggaagatgatgcactcaaacccgtgaagcggaaaaaacagcaccaaaatgagcagtcccgctgccgttaacgtccgcgggtacagccggttcaagcgttttgtattccatttgaaaaatacggccagattgcccaaaagcatccccgcctgaaacattgaatacatgacggcaaaccatacagaatagttctgctgaaaacgctccacagcaagaatcggccccattactgaaataagaccggcaatgacgagatttacgacgaaaaagtatccgaccgatgtcagccatgccgcatttcctttcagcattctgtaaccggcttttacatcttcagccccgttgcttttttcattgggctgttctgaaatacgaatgaacgcgataaatgccgcggagataaaaaaagcagttccgtttatggcaaacagcagcccgaacggaatagccgcaatcatgatcccgctgatcaattttccgacgatgagtccgatcaagtcactcgtattgatcagagatgtcgcctgatcaagatgctgtttgcggacgagcagcggaatgatcgcaactttcgccggcgcaaacagcatcgattgcagagatagacaaaaagcgcacaccccggctatccacacggttaataaatcgttcgcgctgagcaccgccaagaggatcatgatgacggcccggcccgtattgcacaaatacaagatcgacttttttcggaataaatcaatcagcggtcccgccagcacgccaaatgtcaacggcacaagttcgataaaagaaataacgccgacaagaattttgctgccggtcaattccagcactaacagcggcagtgcaataagccagatcccgtccgccgctgaagaaaacacctgcgcacaccaaagctttgcatagttcggtgttcgatatgtcatatcaggcccttttttgatcctcggcatcagaaacaccgccgaaccattccagcgttctccatgattcccgtctttccgtataatcctcttccatcacctcaaatacaatgccggtatcttgattccgataaagctcctgcaaagtatctgcagcccgtctcagcagctcctcagcgatcgtcccttcactcggatggcggccctcaaaacagcggacgccgccatgcgggaacgcaagctggcgaaatgagctgaagtgataatgtttaatgctctcttttatcgagagaaactgaaagaaatccgggtatctcagctggtcatttctgaacataagcgcggaagacaagtgagtctgataggtaatcgcccaatggcacagatcccacgtaataccgacatgtttcagatccagctgaaccagctctgtaaaatcctcaggataaatgaaaatcggatcaaaatcctctcccagattcccgatgatcggaaggttttccacaccgatccaaatgtccgtccctttcagctgctcatcaaactctgcgaaaaactcaatgatttttttacggtttccttccagatcatagacttgaaattcctcaaccgtcataaattgattcgcatgaacggttatgcctttggcgccgtatttcacagcgagctccgcaaagtgataaagctgttttttgatgtgatcttcatgcacataatcggcatgatctgtcgggaaatgcagcgtcaataatgaaggatcaagctgttttgcatattccagcgtctgattgaatgttttgagataatccgcttcactaaaggagcggccgtcaaaaatattcgcttccagaccgtatcccgcttccacccatttctcatcgatttgcttcggatcaagtccgaaaaacggaatttgagcaatcataggacagtcaccatgttcctctcacaagcataaacgcttccgcagcggaaaaacccgattttgctccccatacacgggcattatgttcgattgcctgcaaagaacggggatgagggaagtccctgagctcggagccgtaacacgccatcgatttcaatttcgttttaagttcagcttcaatattaacgaagaagttggcatgaaactgatccttctgacagtaattccattccgtcgaagacaatgtttcataggcaaaaacccgttttaccgtatggccgggaagcggacgggttgcggtcatgaccgctctgaatacgacggagtggtcaatattaatgtcaccgccgtactgggtatacacaatgtcaggctgaaaacgattgatttgtttctccgcttccttcacgacatccagcaaatccattgaatccattctgttatcaggaaggttcagcctgacaaaatcatggatgcccaaagtgctgagcgcttgttccgtttcttgagcagaatgctgcataacggactcttcaggcttctcataatccgtttttcttgatgacttgccttccgccataatgactgccgacacgctgtcaccttggcggacatgtttggcgagcgtgccgccgacgccgataatttcatcgtcgggatgcgctgcaaataccattactttcatcatattgccctcctttaactaacatttcagctgtatccgctccgcagttcatcagcatatcaagcatggagaggtgagggatatgctccccgaataattgaggatagtcaaaatgccggatatgctgatactcaatgacaattccgtttctttcaaaatcgctttctattaaatagtcggaaccctgactgcctgaataataacgatccgcccccagctcccgacaaagcgctaaaacaaaatcgctttttttctccttccggcattcaagctcagagacataacagagcggcgtttcaattcggagctcttttcggaaaaattcaatgatgtgcatattcaaatcatggagatattcccactcccgctgatagacatcttgaaaaaaatgctggtaccgctcaaaatagggagctttcgcatagttcatcttaatcgccatccaatgttttttccgccaatcctgcgtctggtcgattttcatatgccgaagctctatgtctttatattgtttcatctgcaaaggcaccgtcagccatctggggccctgcggcgttttgattctgttgcggttcagaaacccttttttctcaaattgagccgtgtcatgaatggcaaacagatccgacttatacattttttcaaaaaaaccgtaccacggcagataactggattgatggccgcttattgttttcattccggtttcgtaaaaagtcggcattgtttttcttcagctccccaatatcgtttcggtcttgcgatttctttactgtgtgaatagccaaaatcagcccattgaagcttgcggctgatggcgaattgcaaagcgtcacgcatcaacaagtaagaggcctgcgctttttttcccgccaggctgtttacattctgccaataatagaaatgagagcggtcatagagaaaaatactgctgctgatcagcgtctcatcctgatatgctccgccccaaaacatccggtcagcaaacgtgtcaagcagtttttggaaaaatccctggctcagcacataagccgcgccgattgccgacgtatgctctttgtagaggtcataaaacgcgccaagttcttgtcgcccaatcagccgggtgacaatattctctttttcagcgtatctgactgccgtccgggcttttccggaaatgcccgtccaaagttcgtcaaacgtgtccggaagcgtaagaatccgtgtcgccttttccgtccacccttccccgatttcttctgtaaaagaagtctgaccgtacggcagcagcatccgggatatgttccggccgaatatggcctcgatttcactttgaagccattcaaatgagatggggcgatctgaaataacgccgccgtatccgatcatattgccggataatacgcccttctgttcaaaaagcggaagatagatgacctgtcctccgtccgttgtcagtctgacagggtgaaatgacgtgccgggaagctcttccatgagaattccccaatcatagctttgaaacaatcccgcctgatacatgtcagcggcccgatcccatacctgacgggtcgtgcatactgctgttttttgcatagttatcaccactattcagtcttattctgttgctcacaatatgataaaacggattcggctacatatctgacttgctccttttgaagaggaggtttaaacggcagagaaagaactcttttccaaagcggatcttccccttcttccgccgcatatgtttcataaatcggaatacgttcgaggggaagatagttccagcatgtttggatgcctctttcggctaaataaacggaacacccgtaccgctcttcatcccgggggaatacaatcgttaaataattcagatgttctccttcctgaggctggatcatctttatgccgtacgtctcttccgcctttataaagatttctcccgccgcttgtaagtttcggagtgaggctgttacaagctgacccatacgtgaaagctgatcttcaataatggcttcccttgccggatgcatgcgaagcaccggtacaagagccggtttatccggcagagcttctagctttgtggctttcatggaaggcatgacgcccgcttttctataaatatatgaaaggggatgatgccgtttccgtttcataacagcctgtattctttgatttctgatataggatcgatagtcatttgctactcggccgcgccgttccatcgggggagctgcattttgcttcagcaattctttcggcgcgattaacgcgccgcctccgatactcgcaagcggttttgacgggccaaagcttaaaatgccgaaatcgcccagaccgccggcatatgtatccgcttgttttgtaaacatagcttgagcggcatcatcaatgacaaaaataccgtgttccttcgcccagtcaatgatggcggtattttctctccggccgtatacatgcgtgaggataaccgcacacgtctgccgcgtcgctttttttttgacatcctcaaacgataaagaaagatgctcatccagctgcgcaaaaacaggcgttgcaccggattgcactacggcatcaatgacattcgggcagctgaaggatgagaaaatcacttctttccccggcccggctcccgaataagttaaggcgagcaccagtgccgcactgccgctggaggtcagtacaaccccttttccgtaccgtttttccagcttttcagtcagtccgctttgtccggcagtaagcaagtgcttcaccgcgcgcagacggcccctgacggaaagctgtccgggataaacgggatatttgactacttccgggtttttaggaaagtgaaagtttgtgcttttgtctttcatcttttatgatctccaggccttcattcagacttactttcggatcgtaaccgagtaaacgtttcgccttctcgattgacggcgcccgtttaaaaatctcgatgtcttttcccctcacgccgtcttcgcccagctttttaaacaaatagttatccttctctctgcctgagagcacattgactttttcagccagttcttttatcgtgatcggctggtcgtttccgatattgaagtcttcaaagacggccccttcatgaatgagcgcgagataagttccggtgacgatatcactgatgtagctgaagcagcgtatttgtccgccgtctccgtaaagaggcagctcagagccattctcggccaggctgaaaaacttgttgatgacaaaatcctcgcgctgtttcggcccgtatacattaaagtaccggacgacccgaatatgaagttcgtcggaagcctgttctctcaaatattcctctgattgcagtttggcttttccgtaagccgatttcggaagctttcggcttgtctcggtataaggaaaatccggtgaatcgccgaatacttctgagctcgatgagaaaagaagtgttctgattcccaattcaccgcatacctcggtgacgtttttcgttccttcaaaattgacccgtatgacgtcttcttcattgcttcggcagctgtctacaccgaccattgccgccaaatgaacaaccgcatccgctccccgcagtgattcgcggagggacgtccggtcaaggatatccgtttggcggtattcagtgtcaaaagccggctccttttggtctgcaataatggtgtgataacctttagcctgtaataatgccgccaattcgcttccgataaaaccggctcctccgataatcgcaatatgtttcatgatcctacctcctggctgatagtcaaaacttcttttatagacttgacaatatagctgcaatcctcatctgataactggctgtaaagaggcagtgacacgatctcccggaaaacacgttcagtaaccggaagctcggcaggaaaatgtttttgatagtaaggatgcatatgcacgggaataaagtgcacgctgagcccgatctgtttttctttcattttctcaataaacagatctctgtccatgccgccgttctctcggatccgcaaaatgaataaatgccatgagtgcgttatgccgtttggaatgtcagaaagcggaagcgctgctttgtcagattggcccgacagttcacgcacataaaattgagcgatctgtgcccgtttttcttgaatttcgtttgcgcgcttcaattgaaccagaccgagcgcggcctgaatatccgtcatattatatttaaagcccggcagtaacacgtcgtatctccagctgcctttttcaccgtaccggttccaggcattttttgtgatgccgtgccagccgtacagcctcgctctttctgcggcctgttcgtctttcatgacgagggctccgccttcccccgttgtaatatttttggtggcataaaagctgaagcacacggcatctccgtgagtgccgatcatgcttccgttatattttgtaccgagcgcatgagcggcgtcttcaatcagatacaatccgttttctttacaaatggactgcaagttttccagatcagccggatagccggcaaaatgaaccgcaattaccgcttttgtgcgcggcgttattttcttcctgacatcttcaggatcggcacatagacttttctcgcatatatccgcaaacacaggaacggctccggcgtgcaggatgacattgacgctggaacagaacgtgaagctcggcacgatgacttcatcgccttctcccacaccgagcgccaataaagccatgtgtaatgcagcggttcctgaattacagctgatgacgtgttcggctccaatacattctcccagctttttttcaaaatcgattaccttcgggcctttcgaaatccagcccgactgaatcgtttcggttacgcttgcgatttcttcgtttgtcatatcaggtctgtgaaaagagataaatcgattactaatgaccgttccctcctataaagtgacaactctgcaattgtcggctgatttttccctgcatacatttcttgtgtcaaagataatcggtgaggcatccttcaaaatactgtagtcgattacatcgtgatctgtatgaatgatgatgacgtcgtactgattgatttgttcttttgtgaaagggacagattgtttgcggcttccgtcattcaagcggatctcgctgataaacggatcatgataatcaatcgcgcatcccttgtccatcaattcttccattatcgtaaacactgaggattcacgcgggtcatttgtattttttttataagcggcccctattattaagatgctgcatttgtctttgcccgccagtttcaaagcatagtcagagacagaaatcggcatgttagaattgatttcgtccgccagatcaattaattttgtctgcagtcctttttcattcgcgatccatttgaagtaaaaaggatcaatcgggatacaatggcctccgactccggggccagggataaatttttgaaagccgaacggcttcgtgtccgccgcgcagatgacttcccatatatcaatatcgagttcacggcaattaagcgccatttcattgataagagctatattgacataacgataagtattctctaggagtttagctgtttcagctacttcgggtgaggtgaccgggtgaatgcttgtaacaatggtgttgtaaaacgctgaggcaagttctgtgcaagtctgtgtggttccgccgactactttaggaatatctgaaacttcatattgcctgttgcccggatcgattctttccggagaataagccgtaaaaaagtctgttcctattttcatgccgcggcttgatgccattctgtcggcaatcttttttttcgttgttccgggataggtggtgctttctaaaattaaaagctgatgctgccttccataagcgatcatgctgtcaactgcactgtcgatgtaggttaaatcggggatcttgtcttttttgttcaggggtgtcggcacacatatcacaatgatgtcgcatttttggatgagcgacatgtcggcgctgatttgaaagcgttttgtttgtaaagccgagttcagtctgccgtcctctatatcttgaatatggctgcttccggcggctaacaaggaaaccttttcactgtttttgtcgaatccgatcacattgtatcctttatcgacacattccagcgcaagaggaaatcccacatatcccatgcctaacacgcctactatcgcctgcttcgtttcaatcagatgtaacagccgtttttgaccaaggttgctggcttcttttgtgacagtattcatttttcgccccctaatagatagaaaagagtattgttttttacaatttaaaacaaatatcgatcgatatcgcaattataacaaaagttaaaatttgataaatgagttttacatccttttgtgaattaggtattatctatttatttttcttttatttgtaaaataaaatcctgttaaatggtatatatctggtaacgagtgagaaaatctcccttaattgatagaatatacagaaaataatataaaaaaacaggccgaagcctgtttttttattctttcattgcctcagttactgccgcggaaacgagtgctccagctttctctagccgttctttgctgatgtgtttcatattatcattttcggtgtggtaccagggccccggctcctgtgtatcggggctgagccaaatccagttagccgacggaatccccgcttcataaaaagagacatggtctgagtaaccgagctgaatcaggtttggcttgaccaaccgggatttttcagcggctttttcagcgtaccggacactcgggttttccctgccgtcaggagtcgtgacacacatttgactcgcttcttcccagtcagtcgcaatcatatcggcattaaaattggcctggctgtgctttctttcattgttcgtgagtgtactgacgtaataagatgaacccgcagaccataattcttctgcaccgaacaggataaagcggatctctttgtctttcggtatgtgtgtcaattgcttgctgatttccagaacggcagatgtgcctgaggcgttatcatccgctccgggcgcgccttttacgctgtcataatgcgctgtgacataaataatatcagcatcagaagagttggcctgtgccgctttgcgcgttcctatgatattttgtgaggtgcggtttttatagtttttaaattgaatgactgcctgcttttcctgcagcaatgcttcaccgtcttcttttttcatacccgccgccggtatcgtgattcctttatcggtctgcggacggacggcgagcggttttgttgtctgattataaataatgactgctttggctcccgcttgttcggcatgtttgatcttttgagaaacggggatctttccttcgcgtatcactgcaatctttcctttggctcctgttacgtcattgcgtgatccgcagccgccgtcaaaaatcccgccttctattttgagctctttttcaacagcggattgatcagcggagcggagcgggaattcatgatctcccgctgtgactgaacctgaaaagtactttttcaatggaaatgactgtactttgacactggcgccctgagcccgcagacgattcgatatgtattcagccgcttccttttctttcgcggttccggtttcccgcggcccgatggtttcactcagatcatgcatagtgtccaatgcctcatcggcatcaaaaaccggctcggtcacggctgaataagcatgggtttcggacagcggtccggcagatgcgccccatatgacgcttgctgccaccgcggctgacataaatgaaaatttcatcataatccctcctcttattaacacctcttccctttcgattgaagaacactgattcctttaaaaaggggaaaaatgaatattattgaccaaatgaagatggagaaaaaggagggaaaagcccgggaccataaaaaaacgccgggagatattctcccggcgtccattacattacttattcaagttatagaaagagttgataccgtggtattgagcagtttcagccaactgatcttcgatgcgaagaagctggttgtatttcgcaacacggtccgtacgggacggagcacctgttttgatttgtcctgcattagttgccacagcgatgtcagcgattgtgctgtcttcagtttcaccggaacggtgagagataacggcagtgtagcctgcgcgtttcgccatttcgatcgcatcgaatgtttcagtcaatgtaccgatttggtttactttgatcaggatagagttgcctacgccgtttttgataccttcagcaagctttttcgtgtttgtaacgaaaaggtcgtcaccgacaagctgaacttttttgccaagacgctctgtaagaagtttgtggccttcccagtcgttctcgtcaagtccgtcttcgatagagatgattgggtatttagaaaccatttcttcgtaccagtcaaccatttcagcagatgttttcacaacgccttcgccagacagatggtatttgccgtcttctttgttgtagaactcagaagatgcagcatccatagcaagcttcacttcttcgccaggtttgaagccggctttttcgattgcttcaacgattgtttgaagcgcttcttcgttagaaccaaggttcggagcgaatccgccttcgtcacctacagctgtgttcattcctttagcagaaagaactgatttcaggctgtggaagatttgagcgcccatgcgaagcgcttcacggaagttaggcgcgcctacaggcataatcatgaattcttgaatgtctacgttgttgtcagcatgctctccgccgtttacgatgttcatcatcggtacaggaagcgtttttgagttgaatcctccaaggtattggtaaagaggaatctgtaagaaatcagcagctgcgcgcgcacaagccatagatacgccaaggattgcgttcgcaccgagtttgcctttgttttcagttccgtcaagctcgattaaaagctgatcgattgcgttttgttcagttacgtcaaagccgagaagctctggagaaatgatttcgtttacgttgttaacagcagttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgtcgggttgccgcgggagtcaaggacttcgcgtgcataaacatcaacaatgtatggcatgagtttgtctctccttttgatttacgcttatttttgaattaaagatgttccggtcatttctttcggtttttcaacaccgagaaggtctaataacgttggtgcgaggtcgcctaggattccgccttcgcgcagcgtcacgccttctttcgtcacaatgacagggactgggtttgtcgtatgggcagtgtgcggttcgcctgtttctgtaatcagaatgtccgcattaccgtgatcagcggtaatgatggcatgtccgcctttagcgataatagcgtcaaccacttcgcctaagcattcgtccactgcttcaattgctttaatcgtcggttcgaccattccggagtggccgaccatgtcagggtttgcaaagttcaggatgatcgcgtcgtgcttgtcagccgcgatttcttttacaagagcatccttcacttcatacgcgctcatttcaggcttcaggtcatatgtcgcgaccttcggcgagttaatgaggatgcgctcttcgcccgggaattcttcttcgcggccgccgctcataaagaacgtaacgtgcggatacttttcagtttctgcaatgcgaagctgttttaacccgtgctgtgctaatacttcaccgaccgtattgtcaaggtttaccggtttaaaagccacatatccgtcaacagattcactgaagtgagtcaggcagacgaaatacaggtttttcggatgattttcaccgcggtcgaaatcgcggaaatctttgttggtaaacgtgtttgaaatctggatggcgcggtctggtctgaaattatagaaaatcacagaatcgccgtcatgaattttcgcaacgggttcaccgttttcttttgtgatgacggacggaatgacgaattcatcatgaatgccgttcgcataagaatcgtcgactacatccatcgcgctgcggtaagacgggccttcgccgtaagccattgcgcggtacgctttttccacacggtcccagcgtttgtcgcggtccatggagtagtagcgtccggaaatgctggcgatttcgccgacaccgatttcttcgatctgctcattcagctgctgaatgtaagttttcgccgtttgcggacctacatcgcggccgtcgaggaaaccgtgaatatacaccttcgtcagtccttcacttttcgcaagcttcagcagcgcgaataaatgattgatgtgactgtgtacgcctccgtcagaaagaaggccgaacaggtgcagcgctttgtcgttgtctttcgcgtttttgatggcgtcaaggaacgtttgattgcgttcgaattcgccttcgcggatggcaacgttcacgcgtgttaagctttggtacacaatacgtccggcgccgatatttaaatgaccgacttcagagttccccatttgtccttcaggcagtccgactgcttcgcctgatgccgtcagcgtctgatgagggtattggttccaataacggtcgaaattcggttttttcgcttgtgcgactgcgtttccgactgtttcattgcgtaatccgaacccatcaagaatgatgagtgcagctggttttttactcatattgaccttcctccaataattgaacgaatgactgcggttcaaggcttgcgccgccgaccaaagcaccgtcaatatcggactctgccatatattctttaatatttgcaggttttacgctgccgccgtattgaatgcggagcttatcagcagtttcctggctgaagctttcagcaacgactttacggatatgcgcgcagacgtcgtttgcatctttcgctgtagaagatttgcctgttccgattgcccagattggctcgtacgcaataacggaagcggcaacttgctcttcagaaagacccgcaagcccttttttcacttgatcggcaacaagatcatttgtttttccggcttcgcgctcttcaagcgtttcacctacgcaaatgatcggcacaatgccgtgtttgaaagcggcatgcgcttttttgttaactgtttcatcagtttcagcgaacatttcacggcgctcagagtggccgatgacgcagtaatccacgccaaggtctttcagagcgaccgggctgatttcacctgtgaacgcaccgttttcttcaaaatgcatgttttgggcgccgactttcaggtcagttcctttaacagcagaagtcagcttttctaagaaaagagctggtgcgcaaacaacggcttccgctttgtctgctgctggaatggaagatttcacttcttcaacgaagctgacagcctcgccgagtgttttgttcattttccagttaccggctataattggttttctcatctgttccacttccttatagcagtttttatttatcgttcagcgcagctacacccggaagctctttgccttccatgaattcaagggatgcgccgccgcctgttgagatatggctcattttgtcagcaaggccgaatttttcaacggctgccgcagagtctcctccgccgatgacagagtatgtatcgtttgcctctgccaatgcttcagccactgcttttgtgccttgagcgaacaagtcgatttcgaatacgcccatcggtccgttccatacgacaagtttgctgtttttgataacttcagcgtacgtttcgcgggttttcgttccgatgtcgatcgcttctaaatcacttgggatctcagagatcggcacgatttgaacgtttgcatcgttagagaaatcatcagcaacgagaacgtcttccggcatatagaatttaacgcctttttctttcgcgcggtccatgaatgattttgcaagttcgattttatcttcttcaagaagagatttaccgacttcatagccaagcgcttttacgaatgtgtaagcaagacctccgccgatgatcaggttgtccactttatcaagcagactttcgattacgccgattttgtcttttactttcgcgccgccgatgattgccgtaaacgggcgctcaggatttgtcacggctttgccgagaacgtcaagctctttttccatcaggaatcctgcaaccgccggcagatgctcggcaattccggctgtagatgcgtgagcacggtgggcagcaccgaatgcgtcattgacatatacatccgcaagctcagcaaatgctttagcaagctcaggatcgtttttctcttcaccaggatagaaacgtacgttttccaatacaagaacgtctccgtccttcatatcagaaatttgtgcttttacagcatcgccgtaagcttcatccgcttttttcacttcttttccgagcagttcgcctaagcgtgcagcgacaggagttaaacgaagctcctcaaccacttcgcctttcgggcggcctaagtggctcgcaagaaggactttcgcgccttggtctgcaaggtgtttgattgttggaagcgcagctcggatacgagtatcgtctgttacttccccgtctttcattggaacgttaaagtcaacgcggcagaatacgactttgccttttacgtcgatgtcttttactgtttttttattcatgccttaggagatcctccttcaaaatggtttgcatagcacgaaaaacgtgaaacgtgaaaccgcctcatgatgcttccgccgcggggcagattgcagcttccgggcacggggcagatcgtcttctgagccagggcaggcggctcagaaaacgaaagtgccgcggaaacttcaaaacgcggacgttctgcagcaatccggcgctttctgaaagccggttctcatggaaaaagggaaagggagtccgtccccttcccttgtccgctttcattatagcgtttctgtccgaaagaaccaagtccggccctttccgggagctatgaattaaagaccttgttttgcgatgtaagctgcaaggtcaacaacgcggttagagtagccgctttcgttatcgtaccaagagattacttttaccatgctgccttccataaccattgtagaaagagcatcgattgtagaagagttagcattgccgttgtagtctccggatactaatggctcttcgctgtatccaaggattcctttaagatcgccttcagccgcttctttaagagctgcgtttacgtcttcagccgttacgtctttgttaagttcagcaactaggtcaacaagagaaacgtttggagtcggcacacgcatagctccgccgttcagtttgcctttcagttcaggaagaacaagggaaactgctttagcagcaccagttgatgtaggaatgatgttttcagctgctgcacgcgcacgacggtagtctttgtgcggaagatcaagaatttgctgatcgtttgtgtaagagtgaacagttgtcatcataccgcgtttgatgccgaatttgtcgttaagtacttttgcaaacggcgcaaggcagtttgttgtgcaagatgcgttagagataacatggtggttagccgcatcgtatttgtcttcgttaacacccataacgattgtgatatcttcttcgttagcaggtgcagagatgataacttttttcgcgcctgcttctaagtgtttcgcagcgtctgcgcgttttgtgaagaaaccagtagattcaactacgatttcaacgccttgtttgccccagctgagtttcgcaggatcgcgctcagcagaaacttcgattgttttgccgttaacaacaaggttgctgccgtcaactttaacttctgcatctaattttccgtgtacggaatcatattgtaaaagatgagcaagcatgttagcgtctgttaaatcgttaactgctactacctcaacttcaggattgtttaatgctgcgcggaatacgttacgtccaatacgaccaaaaccgttaataccgacttttactgccatgattatttcctcctttaaataagtgagagatatttatattgagggactgttatcccttaataacttctttgcggctccttcgtccgtgacgagaaccgtgtttcgctgctttttaaaataagcttcgattgcttccgcttttgatgatccgcccgctaccgcaataatgtcgggaatggcatcgaggtcatcgagctgcattccgactgaatgcaccttgtgaacgacttctccgtccgcattaaagtagtagccgaatgcctctgtcaccgcatgattgtcatctattttcttcaaatcttccaaaggcgtgtttcttcgctccgccattgttctagcttcgccgattccgtgaacgagcatactcgctgatttaatcgtgtgaagcacctcttttacggaaggttcttcaataatagatgagtaggcgccttgtgacagctgtccgggaacgaacaaaagccggtaagtgcctgaagccttttccgccatatgcgcgcatatggtgttcgcctggtttttcacgtcttcgcctaaaccgcctcttgcgggcacaaacaggagctcgcggttttttgaatccggcgtcatcatatcggcgacggcttcaattgtcgtaccgccggttacagcgacgatatttttgcctgaaaatctctttttcatacatgcaacggccgctctccctaattcttttttgacccaaggagattggtcgctgtctccggaaacaataatggcgtctttcagattaagccgctcttttaatgtcttttccaaaagcgtcaatcctaaaacatccttcatcgtatcttccagaatcgaaagcagtgaatagccctcttccgtcattgtcatgccgtttgttttaatatcgatgagattctgttctttcaagaactgaacctcgcttctgagaacgcgctcggtcaatccgagactggctgcaagacttctgcggccgatcggttctgtaagcctgatatactgcaagatttcaaatcttttctgcatcacaagcaaaagatcaggcaataattttttttgagcttgtattaactggttcatgactcaaacgttccttcctattcatactggacagaaaatgtcccgctatgacaaaaaacgtcccatcatagccaaaaaaaattatgtctgctttctttaattattttaacaggatgacattgttaattcaactgttaaaggtcaattcctcgacattcttcgcaggatttaccagtatctccttgatacagtcattatatacagaaacggaatgaaggtgacagacaaaagcccgccggagcggacttttgtcgtaaaacgctttcattttatccagagtttttctatttcttctaatgatttatttttcgtctcagggcagatcgtcacgacaaacaagaaacagagaatattaatgacggcgaatatccagaaggtgtacgcgagccctaacccgctgatcatcatcggcacgaactggccgatcgcccagttggccccccataagaatatcgtcgcaataccggcggcgcgtgcgcggaggtggttcggaaagatttccgaaatcatgatccacgtaatcggcccgactgatacgcagaaagcggcgacgaatcccaatatgatgacgactaaagccggaccgctcgccagctgaaaataaaaggatgccccgattaagatcatgaatagcgccataaaggcagatccgacccccatcagctttttccggcctaccttatcgactaaaagaaccgcgataatggtgaaaatcacttcaacgacaccgacgatgcatgtcgtgataaaccccgcattctgtccgaagcccatcattttgaaaatttccggcccgtaatacgtaattgcgttcatgccgatgacctgattgaataaagccagcagaatcccgatcacaagcgcttttctcagccccggtttaaacagctgagacaatgaacccattttttctaattgtaaagacgtttcgatttgtttgatttcttctttcgcggtctgctcgccgttaattcgcgtcagcacggcgagggcttcattccggcgccccgctttcgcaagccagcgcggactttccggcacgataagcagcacgataaaaaagatgacggacggaatcatgccgtaagcgagcatccaccgccagccggtgtgcaccccccattcatacgagccggactgctggacggcgaggttaataaaataagtgccggatatccctaatatcgtaaacagctgatacagcgaagacagactgccgcgtatggccggcggagccgcttcggtaatatacgtgacagaaagcgaggagcccatgccgattccgagaccgccgatgactctggcgatcactaaggaagacacactttgagaaagcgcagagacaaccgctgacaccgcaaacaacagagccgctgccatcaaaatctttctccgtccgaaacggtcactcaaaaatccggaaattccgacgccgaaaacaccgccgatcataatgcttgaaatcacgagcccttccataaaaggacttaagcggtacaaatctttcaggaaaccgatggcgccggaaatcaccgccgtgtcataaccgtacaaaagccctcccagtccggccgcgcatgagatgagaatgacaaaccacttggaatgctgccgagtgacaggtacatttgagccaattggtgccgggtgattcttcatgaattttaccctcccgcgaataatagaataaaaacgcttacaaaacagagtgcggcgcttgacgttgctttgttttcttcagaaccgccacatttgtacgtacttataaagaattttatctaaaaataaggaaaattagtacgtacaaataaagaataagcagtttttcataatctgtcaattatttttacagcttgatgaaagggcttactatgttatactggaatttgtccgtatacattttggaggaattgatatgctaccgaaatatgctcaagtaaaagaagaaatttgttcatggctgaatcaaggaaaaatacagccggacgaaaagctgcctacggaaaatgagctgatgcagcagttcggggtcagccgccataccatcagaaaggcgatcggagatttggtctcgcaggggctgctgtacagcgttcagggcggaggcacctttgtcgcttcacgcacggcgaaatcagccatgcattcaaacaaaacgatcggtgtcattacaacgtacatatcagactatattttcccgagcatcatcaggggaattgaatcttatttaagcgaacagggctattccatgctgctgacgagcaccaacaacaatacagaaagtgagcggcgcggccttgaaaacctgctgtccaaaaatatagacgggctgattgtcgagcctacgaaaagcgcgctgcagacgcccaacatcggctactatctcaacctggagaaaaacggcattccgtttgccatgattaacgcctcttatgcggagctggccgcaccgagcttttccgtcaatgatgtcaaaggcggcatgatggcttgcgaatacgtcatgtccctcggccacacgcacattatgggtatctttaaagcggatgacacgcagggcgtcaaacggatgaacggctatcttcaggcgcaccgggagcgcgggattttcccgtctccggacatgatcgtgacttacacgactgaagaaaaagaaaccgtgcttcttcaaaaaattaagcatacccttgagcaaaacagcggatcatacccgacggccattctttgttataatgatgaaattgcgctgaagacgattaatcttctcagagaattcggattaaaggtgcctgatgacgtgtcaatcatgggctatgatgattcacatttcgcccagatttccgaggtgaagctcacctctgtcaagcatccgaaatccattatggggaaagcggcggcaaaatacgtcatcgactgcttagagcataaaaaaccgaagaaggatgacgtcgtgtatgaaccggaactcgtcatccggaattccgtcaggcggatcggcgaataaaaatgggcagatacaatagtatctgcccatcagtcattaaattgaaaactaagctgaaaatcatgaggcggaagaacatcatctatattttctttattaaaatgctttaaaatataataaaataacgaatctgaaatatatagtcttttatcatagtatgtaaagacctttggaaagatatcctttttggattgcaattcatcgaagtgattaagtacagaggtcagcgcaccatgatttattgactttttctcatggattcggtgaatattctcatataagtactgaaaagaaaatcctctcctcgctatatctggatcagatgttaacacaattttcattatataatagtataacttcagcttcgcttttctttctccatctgcaatgtcttgtatttttgtcaaatattcctcgcttactcttttataatacagagcattacattccttagctaattcaagactgtcaagaacaatgtaattccgacttctctttcttattccactttcacgacaaaagtcaaaaagaagttgttgatatacagcaactatttggctggatgcctctataaaataatttgttacattttcactaatgtctatgttcagctctttacagcctctactctttatattcattaaatctctagtagaccatttagtagcatcaatataatcaatcctttgagataattctccattgaatttttcaaaatagccatttataatttttgtcccgattataatgaatcttaagccgctttgataaaacattttcaggtcaaaagccaacagatattgatcgactaaatttaaataatgaaagtcatccagtacgataaactgaatacctttttccttcagtgattcagccactctgacacttacggttttgggaagatccattttccctgattcacttaataactctttttcagatgaatctccggtcactttcgcttttaaaaattgaaatagatttgcctctacttgactatcaatttttgagcacttttcaatacttttggagaagttatcagatatctccacaccagatttgtataaaatctgtgtgtaaatatcagctaaatcaactcccttcgtacagtctatcactatagtgttttcagctttggttacatatttttttcttaataatgtttttccgacttttgtttcgccatatattacgatgtgatgatccgtaagttcaattttatcttggtaatcctcatcaatttgttgtctatcaacataactttttaaaacattccgcgatataccaaaaacatctttcaaagaaacatccaaatttttattccctccctatatttcaagaaaatttttctaataaataatatcataatagtatgaaatttcatattattacataaaaacaggcagcacactatataatatgtgctgcctgtttttcatctttttaattcggcaatgatttcaaatgatctcattctgtcggcatgctcaaagctttctgaattcaccatgatttcatccgcctgggttgtccggatgaagctttccagcttttccttcacacgctccggtcctccgacgatcgttgaactgagctgttcattgaccatcgctttttcatacggcgaccagatttgatccatgtcttcaacaggaggcttcagctggttcggcgtgccgcggacgaggtctaaaaatctttgataatgcgatgtcgccagatgctccgccttttcatccgtatcggcggcaatgacggtgacgccgaccatcgcgtacggttgatccagtacgtctgacggacggaaggagcttcggtacagctcaagggcgggcacggtgtttttcggtgagaagtgagccgcaaaggcgaacggaaggccgagctctcccgcaagacgcgcgctgaagccgctcgagcccaaaagccaaatcggcacgtccagcccttcgcccggaatggcgcggacttgattgcgcacattgcctgtcggtttgaagtaatttctcaattcttcaagctgctccggaaaatcttccccgctgtttatgtttcttcttaaggctctcgccgttaattggtcggttcccggcgcgcgtccgagccccaggtcaatcctccccggatataacgtttcaagggttccgaattgctccgcgattataagtgacgaatgattcggcagcataatgccccctgaaccgacgcggatttttttcgtgccgccggcgatgtggccgatcagcaccgccgttgccgagctggcgactccttctatattatgatgctccgcaagccaatagcggttatagccccactcctcggcgcggcgcgctaaatccatgctgttgcggaacgattcagcaaccgttcccccctgtacgaccggcgataaattcaatacggaaaacgcagtatctttcaatgtatgttcagccatcgttttctcctttatggtttagtgtaagcagatcttaaacaaggtctctaccacacaccttaccacagcttttcccgtgagttaaacaatttgattcgatgatcttcgaacaatcagtcagcggtcgtcactagtgaactctgtatgaatgaatctattacattcagatatgaagagcttttcatcctataaaagtgaaaatctctcgttgaaaaaacatatccaataatgttaagatatgtatgatattgaataggaaggaagtcatagtctatatgcgtaaaaaaatcttaatggcactcaccacagctttactggcagcaatcttctttaccggaaacaccgataaggcatatgccgcagacttttattccggcactcagcagcatttaaatgtaagcggatttaccgatgcctcctactacacgaaaaaagcgaaaagtgtcgattttactctcagtacagcgtatccgtcagatcgaacttttaaaggaaacctatacttacagcgaaagtcaggaaagaaatggacgacttgcaaaaaaacaaccttttctttctcagtaagggtgactaagtcattctctttaaaaggatgcaagacaggttattatcgtgtcaaagctacgttcagcggttcaaaacttgtcaatacgacaaactcttttaaaattaaccgataagattcaggaccctaagatttttagggtctttttattcattctttgtgagctcctgcgcgatttgaataaaaagttttgcagctaatgaagcctcttttacagacggaacggcaagcagaacatcacggtacaccgcctgattgagttcccttgtcacgacattttccggcagcgatattccggacatagacatttgtgataatatcgcaattcccagtccctctttgatcatgctgatggacgtattgacgttgtaaacagtgaatgcggcagtcagcacagatcctgcctccttaaacatatcaataaacgatgattcgtatcctccgtcacagatgatcatcggctggcggtcaagatctttcagagtgattgactcacagctgcaaagcggatgatcatttctaagcacgacggccattttatcttttttcagcggcagatattccatgtcttccgtaggaaaaagagtgatacccacatctattacccgggagcggagccattcctttacttcgttaaccgttccttcatgaagtaccaactcaagcttcggataccgttttttaaacacgctgatcagttttggaatgaaataagcggaagcggccggaaatgtgccgatgtgaatcgttccctgttcaagccctctttccgcggccgccagctgctcggctttttctatgcctttgagcacctctctgatatgaacgagaatttttccgcccgtgtccgtgagccttacgccgttgcggcgctcgcggatgatcagcttgatgccgagctctgactcaagcgccgagatggcatggctgacggcgggctgcgtcatattcagcgcctgccccgcttttgtaaaacttcccgtttcagcgatttgaacaaaaacccgcagttgtgtaatcgtcataacgttttacttatgctcctcataaaaaagattcattttatttatcttactgattaccgtatcatatgatggaattgttctacaaggagtgaacgacgtgaaacagctttcgaaaatacagacggctcttatgctggcgtttctagtcacggtatggggaattaactggccgctgacaaaggccgcgcttgcctattcgccgcctcttctgtttgccggaatccgcacgctgatcggcggacttctattattaatggtggcgctgccccgttttaaaaagctgcgttttaaagaaacgtggccgatctatctgatttctgccattttaaatattactttattttacggcctgcaaacggtcggcttgaattacctgcctgccggcttattttcagctatcgtgtttttccagccggtgttaatgggcgttttttcttggctgtggctcggggaagcgatgtatcctttaaaaatagccggtcttattctgggctttgccggtgtcgccgtcatcagcgcagccggtttcggaggccatatttccatcgccggcattcttttggccttaggctccgcggtcagctgggcgctcggcacggtatatgtgaaaagaacgggcggacgcgcggactctatctggatggtcgctcttcagcttctgatcggcggcgtgctgcttgtcagctccggccatttatcagaaagcttttcagcgattcaatggaaagctccgttcattctcagtcttctgttcatttcggtatttgtcatcgcgctcggctggctcgccttttttacgcttgtcggttcaggggaagcaagcaaggttgcctcttacaccttcctgatcccgctcatatccattgtcgtcagctcgatatttctgcatgagccgctgaccgtcagccttttagccggactgcttctgatcgtcacaagcatttgttttgtgaatataacaccgaagaaactgaaaacacctgctctggccgcagaaaaaaaggccgttcattaaaaaaactcttgccgctgggcaagagtttttttatttattgacgtctccctttcacgagatacgcagccgtaataagcaggtagatggccgcagtgatgcatgtgatgacgatggatgtcgtcgcaattacgccgatcaggatggccaaaagcgcaagcaccgcgaaccatgtcgtgtacgggaaccatttgacgtaataagccggctgttctgttgaatgttttcttgattttaaatgggcgaatccaataatcagccagatgaacagcacggtatagccgagggaacccatcaaataattaaacgtctggcttcccgcaaataatgaaatcaggacgcctacatataaaaatgacgtacaagtcagaatcgcatagacgggaacctttttcttcgatagttttgaaaagattttcggcacccggccgtcagaagcctgcgtaaataagacgcgggatgatccgtacagtcccgagttcatagacgagataatcgcaagaagaatgacggcattcataatatggtcggcacccggaattccgatcatcttaaatactatgacaaacgggctttcgggaacgctgttgacttgattccaaggaatcaggctgacgatgatgaaaaacggcagcaagtaaaaagcgacaatccgcgttaacgtgcttcggacagctttcggaatcaccttttcggggttttttgtctccgccagcgtgacgccgatgatttccgttccgccgtatgagtagatcacgacgagcatcgccgtaatgacgccccccgctccatgcgggaaaaaccctccgtgatccgttaaatgagacagccccggcgccgtgtgattgccgaatgagaaaaataatagcagaattccgcataatataaagatgacaatcaccgtaattttaatgagcgcgagccagtactccgtctcggcaaacagtttcacagaaagcatgtttacgaccgtcaccacgatggaaatgatcaaagccagtatccatatcggacattccggcagccaatattgaatgaaaatggcggctacgaccgcctccgcggcaatattgagcacccacattttccaatagatccagtctaaaaagtatgcagcgtacgaaccgagagactgctgaaccaaatcacggaacgtccttgcatgtttgtttctgacggccatttcggccagcccctgcataataaacagcagaatgataccgccgaggaggtaggccagtaacacggacggccccgcttcatcaatcgccgtgctgctgcctttaaagagcccggccccgattgcgcctccaagcgccatcatcataatgtgtctggacgacatcgtccgttttaacgtttgcttgtccttttccatttatcacacgccctctcgcaaaaagtgttcatcacataaaaaagcacgccgcctctttaggaaaagagacggcgtgcctcaggcagccgcggtaccactcttgttgatcccgaatatccggaatccagcttaaaaaccttttaacgaaggtcagccgttaggacatagggaatattccgacaattccgttccgccctgccacttccgggcgagttcaaagaacaatcagtccgcgtttcaccaacccgcggctctctttttctgactggattcttttactgctcccgttcacagtgttttatgttaaatgaatctcttgagtttttattttctgaatatagtaacataatatacagccttctattttcaaagtcaatactaattttttccgctggttttcttatcacctatataagacattttgactgaacatgtttatcttcatatgaggattgagacggctcctaatatggcgtaatcggcatatatggactgagcggcaaaaagttggcagaaatatgaaaggttactcttattccggtatctcagcttagtaactgtacacatttcatttctaatagttcaactccaatgactccacaaagttctatacccggaagtcatattccatttattaaagctattgacatgaaaccaattccacaaattaaactcgtggagaacactagttggcgtaacacgaaacagtatagatgtattagtggcgttacagctagtgtttttgagtttttaaaggagattttcaggatataaataacaataacgagaaaatcaggtgcagaaagttgaataaaatacctatttttttacaaagaatgataataaagggttgatatggtacgggtttcatactttaagatgatgatgtgtcttcactgaatactaaataaacatttccaggaggcgtttcctatgcagtccagcacatcatttaacagcccggcataccttgaaacaaatggagtaatgaaaatcgctgatataacctatagtaataatgaatggctgaacttcgacattggaggagaagggatttttaagaaatcaggttcttatttagttccatctcttccagtagaatttcattgtcatggaatcggtgactatgattttagcaatttagaccaattagatattgaaaagatcaatacactagctgaaatagaagggattttctgtgtaccgtctatctttcttcctcataatcaattagatcaatttgcagcctttatgaaagagttccatacacaaaagagaaagggacgttaccgtaatattttaggtatttcactagaaggaccattattggccagctttgcaggcacaccggaaaaagggaattgggcacccttaaaagaagaatgggaaaagatcgcttcatgtggagaatacggtcttatttatactgtactgtctccagatgctatgactgaaaactcctatctaaagaaatatatcaccgaaaaacatcccagtttagaatggattgtagatacacttgtggaggctggagtaaaaccggcgctgggtcacttccaaaaagcatacccggaggaaacctctgaacttataatgaaagttatagatacagcgcaaaaacgcagcaaatacactggatcagatgccgttttaacagatcatttgtttaatgatatgccaaacaattttaaacacacctggagaacaccccaagaaagagtacatagattagaggggttaaaagatgctcggttagataaatggaacatagataatatcaacacacttgtcggagaagttcccggtactttgatgagagccgcgaaagaaggtttattaaccatttgtatgaattttgatagtgaacatgtagacttagaagttgcacggcgggttgtagaacttgttggctctaagggtattatagcaatgacagatcgcattgacacagattccatgtgcggccagtcattggaaaaaattgaagggaataatctgtggtatcaaggaaaagggtatgtagcagcagggtcttacacaattgatcggcttatgcataatattcgtgctataggttttagtgagaaagttgtatggaatatgacatcatttgtaccattaaaagcttgtcatttcctaaatgaacttgaaaacctatccatgaagcccttcagttttatagatgaaacgaaaaaaagagctcatttcaaagcgcctgccccagagctgattctgcgctaagcaaaaaagaccaccataaagtggtctttttaagttgactttcttttaataagttttaggtccaacttatttatattggggacatctttgttattcattaagttatataataaatttgctgctgtttgtcccaactctttaataggttgatgtatcgttgaaagttctattaccttagatatcggctgattatcaaatcctataaccgccagttcttcgggtattcgtattccctgtcttttcgcttcataaatgatccccgccgcaacataatcacttcctacaaccattgccgcaggacgaggtgacttattaagtaataattttgctatttctataccattctcaatagtgtactgttcctcaaagtaccaattatcactccatttcaacccgtattcattttgaaagtgaaaaaatgatttttttctgcttatgccaacaccgctcttaggatttcctatacacagaccaatggattgatgtccttgatttcgcagatgatcaattgccattttgattcctgactcatgattaataaatatatgtgcaacctgtttgctcgcagaagcttcacaggaaacaatattaccaaacccagatatctcgtcgagtacgtgatgggggcttacacaggatcccaaaataagaccgtcaataagtttgtatttcaatctgttaaaaaactccatttcttgttcaggatcgttatttgattggtgcacaagtaaactgtaattatgtttattacactcttcgcctattccggcaatcagtttactgaaaaacggatggttgattttaggaacaatgactccgaaaacatttgtcttccccctggataggttaatcgcgttgaaattcggtacataatttaattccttcatagcttttaacacagcgtcccgcttctcaggttttacataaggatgattattgagaactctagaaactgttgtccgagaaacgttcgctttctttgctatctctgtaatgtttgtcattactgctactcctttttagacagcgttatcaggatttcacactgaacaacacaagggaaaaaagcatttaattcattgttttatcatggcctgcatgaatatgtgcgccttcctgtcccacactatagatagaacggggcttccccatcttgtgtaatagtttgtcaaataaacctactaatatccccagacacagcagcacaatgatggttcctatcccaatcggcccctgaagaatgattgcaagcacaaaagctaaagcttcccctatcgtctttgtaatatgaataccccaacctgtacgttcagtaatagccaacattaattcatcattcggtatcgaaggaaaagatgctcttaaataaatagcgattcccatagccaatatacacaaccctatcaaaaataaactccattgaagaattacagcatctgtttttaagaacgaaagaacctttaagtttaaaaggtcaacaaaacttccaataataacaatcggaataaaaccggctaaattaggaaaccgcatttttatgaggctgtttataaagataagaattcctccgacgatgaaaacccatgacccgattgtaaggccaatgagttctgataaagccacgttcagagcatcccagggggcaatcccggtattagatttaatcatacatacaacccctacggataaaataaacaatccgacaatatagattaaacatcttttcacaaaatggatcatggctgtatactccgcggtttagggtcttcttctttcgtcagaatgtagtgatcaaaagcataagatacaccacactcatcattcgttaacgttttaaaagcagccaattgaataagcttcttatctgcatttcccatggctatccctattcctgctgcacgaaacataggcagatcatttagattatcacctattgcgattgcattccgcgcatccgttccataatgttcacaaagtttatttaatgacgctcctttatctactcctgaacttgtgatttcaagattgaatgctcctgaactcgttacggcacactccttcagttgtccaaaatattcttttgctttttttaattttctttggtttggcgaaacgatcatacattttatgacataccgataatcgatagggtcaattgtacccggtatttcctctaacccgtattgatgtatctgagctttaatagaattccaaaatacttcttgattaaaatgaggttcttccattactgtattgtaaagttctttttcaagcagctgaattccttgatttgatacggcaattttgtcagataagtaaagctgataatagatttcctctttatttaaccatgtgatgataggttggattacatctgaatccataaaatgttcgaatattaactgatttcccacatcaatttgagcgccgtttgaagcaatgatcggaaaatccaaatcatatttattgatgatgtgttttgcatcaaataaagctctccctgtagcgattgttacaagatgaccttgtttttgtccgagctttaaagctcttacatcttgttcttggatagttaagttctctgataacagcgtgccatctaagtcaattgcaattactttcatgtgaatttcctcctcagagtttaaaaatcattgaaagtataatgtatggtacgcgtttcagagcaattagattattatattaatttgaagtttttctgagaagctgatcagactgtgcttctcaagtgttctcctgcttaataatccttctctttcgatcaatccagttaataatgaactgactgctaatggccgaacactaatttgaagaaattcatctggaacttcaagcgccggcgacttgggcaccggcgcttttcagagaacgatcactttttgtaaaatcggatgtctgaagtgtcattgaggcggtttccccgatatacttttctcttttctttcatttgcggtaaagaaagcaaaacctgattcccttatgacagaacttgctttatcataaaagtatgcgtttacattcgagtagggaggttatagtatgacccctgtgaattcaagcagcatcggaaagattcaggcggccagcaaagggttgtcgccaaaattgagagcgattgcagaccatatcgtgaaggaaccgaaagacgtggttcacctttccatcattcagctggccgaaaaaacgaaaagctctgaagcgacgattttcaggctgtgcaagcggctcggtttttccggctatcaggatttaaaaatcgcgcttgctcaagagatcgttcaggagccggtgcagcacattcatgaagaaatgagccccgacgacgatatcgaagtcatcatccggaaagttttccgcacaaacatttccggtctgactgatacctttcaattattagatccggccgacgttgaaaaagcggcagaaatgatccaccgcgcagacagaatcgaattttacggaaacggcggttccgggctgatcgccactgacgcgtatcataaatttatgcgtacgggtataaattgcatcgcgcacacggattctcactttcaggcgatgtcagcgggtcttctcggtcccgaaagcgcagtcatcggcatttctcattcggggagcaacaaggacgtgctcgacgcggtgaaaacggccaaatcgctcggcgccggcacgatcggcattacaagctaccaaaagtcgccgctcacccagatttccgacgttgtgctgtatacatcaacaagggagacggctttcagaacggaggcgatgtccgcaaggcttgcccagctgtcggtcattgatacactgtatttcgccacggcccggttgcggcaggagaaaacgctcgccaacttgcagcaaatcagaaaaatgatcgcgcacaaacgtttgtaatatttatttttcaaaagagagaatgccgatacagcgggaattgaggcaattttatgaaaaaaattttcttcttcatcgttgatttataaaaaaattattcctataattgactttgtaagggcatacattataaatctatcttattattcaatcagattaggcgggatatattatgaaggaaacccaagctgttatcggtctggatatcggcacgaccagtacgaaagccgttctgttcggaccaagaggcaaagtgttagccaagcattcggttcactatgatttaatacagccaaagccggcatgggccgagcaggatcctgagcacattttggaagcggtgatcggaagcatcaggggcgccgtcacaaaggccggactgagtcctgacaatctgcttgcaatcggcatcagcaccgccatgcactcattgatagctgtcgatcaaaacggcggcctgctgaccaaaagcatcatttgggcggacaaccgcagcgccgagcaatcaaaacggattttaaaagagatgaacggttttgatatttataaaagaacgggtacgccgattcacccgatgtctccgctttccaaaattgtgtggatgaaagaacaggatcaggagacattcgcgaaaaccgccaaattcatcagtattaaagaatatattctgcacgagtttttcggaacttatgtcgtcgattattcgatcgcttcggcaacggggctgttccgattagatacgctttcctgggatgaagaagcgctccggattgccggaatccgggaagatcagctgtcggacatcgtgccgaccactcatcagctgcgcggccttgcgccggaaatcgctgcacggatgggcattcatgcggatacaccgtttattatcggcgcaaatgacggcgtgctcgccaacctgggagtcggcgcgatcggcaaaggcgaagtggccgttacgatcggaacaagcggagccgtgcgttcggtgacggatgcgccgattacggatgaaaaagcgcggacattctgttacgcgctgactgacaagcattgggtcatcggaggcccgacgaataacggaggcattatgctgcgctggcttcgagacgaattcgcttctccggaagttgaaacggcgaagcggctcggcattgatccgtacgatttaatgattgatattgctgataaagtgcccgcaggctctgagggattgctgtttctgccgtttttatcaggggagcgcgcgccgttttggaacccgaatgcccgcggaacgtttttcggcatcagcctccgccataaacgggagcattttatcagagcggtgctggaaggcgtcatcatgagcgtcttttcaatcggtgtcgcactgagagatttggcgggccccgcaaaagacgtgcgggcttcgggaggatttgcgagatcgccgctgtggaggcagattttgtccgatacgatgggacgggaagtcctcgttccggaaagttacgaagcctcggcgctcggagcggccgttctcgctttgcacagccttggcgaaatggaacggatcgaggatgttcaggactggatcagaatttcgcaccgccatgaaccgaacgtcaaaaacagcgaaacatatattgagctgttttacttatacgagcggctgtatgacaagctcaaagatgaatttgacgtcatcagtgaatttcagctcaaacaaagccggtaattcttctttgaaagggtgaaaaggtcatgttactgtttattgtcattgccgctattatcgttttactcttattgattacggtcgctaaattaaatccgtttatcagtcttttgattacatccatccttgtcggtttcgcaacgggcatgaatctgccggacattatcacttcgatgaaaaccgggctcggcaatacgctgtcgctgcttgcgatcgtgctggccctcggtacgatgctcggcaaaatgatggctgaatcaggcggtgcggagcggatcgcccacaccctgatcggccgcttcggcaaaaagaaagtgcattgggcgatgatggccgtcgcttttatcgtcggcatcccggtctttttccaggtcggcttcgtcctgctcgtgccgcttttgtttacgattgcgattgaaaccggggtttcattagtgacgatcgggattccgctccttgcgggactttccgtcgtgcacggattggttccgccccacccggcggcgatggcggctgtcggcatttatcacgccaatgtcggaaaaacgattttgttttctttaatcgtcggcatcccgactgccatcatcgcggggccgctttacggaaaatggattggtaagcgcattcataaacccgttcccgaactgttgaaaaaacaatttattgaacggaatgaaaaacgcaagcttccgggattcgcaaatacattgtttacgatattggtaccggtgatcctgatgcttatggcaacgcttgccgaaattgcgcttccggaaaaaagcacgctctatgaaacttttaaatttatcggcgaccctgtcacggcgcttttgatcgccacggtttactcctttttcagccttggtttttatcagggatttgacagagaaagcattttaaaattcagcaatgactgtctcggaccgatcgcttccattctgcttgtgatcggagccggcggcgcttttaacaacgtcctgattgattcaggcgtcggcacgtatatcgctgacatggcgaaacactcaagcttctctcccgttcttttaagctggacgatcgcggcggtcatccgtgttgccacgggttcagcgactgtcgccatgatgacggcggccggcattgttgctccgattgcatctgtcatgccgggcgtcagcagcgagcttctcgttttggcaacgggagcgggctctttgattctgtcacatgtcaatgactccggtttctggctcattaaagagtatttcggaatgacggtaaaagaaacgttcctgacatggacggcgatggaaacgattatttctgtcagtgcgatctgttttatcatgatcattaacgcgtttatataaaaacaaaccccggccgtaaaccggggtttgtttttttatcggtcattcacgaggatataagcggctttaacgggtccgtggacgccgacaaccaaatccatttcgatatcggccgagttgctcggtccggtaatatagttgatgcaggaaggaatggtgacgccgtctctgatctgctgtttcagtatatcgctggcctgtgtcatcctcggcacaatggaagatttcgggatgattgcgatataggtggtcggaagcaggctgacggaacggccggcatgctctgacgcatacaaaacgacggtggctgattccgcaagcgtgatctcgctgaatgtgatgcccacattcgcttgttccgctttttcaatatttttcgctccttgttccgcgtcccattcccaaacggaaatcccttcgtccggccactcttctgtcataagggtctgcaagccgtacatttcaaaccggctgtccttcggaatgatgacaggccctccttcaaagcggttcacctgcgcgcgcaaagcgtcgtaaagcccggcggcatccgtttcgatcagttcggtatgaatgttgacgcagtggtctttcagcatcgtgacaagatcgtcttccgtacagtccgcatgcgtttgatattgaggctgatacttccattcaggcagggacacgcctgatttcctgcgctctctgcccagacttccggcgatccggtttagaaaggattcctgatgtgtaaccgtccctttcatcatcattcttcccccttttgtttttcccggtctttaaaccaatctctgaatctcgatttatgcggcgcagggaagtcccgtattgccgtccattcttttaacggccccggcccttttgatattttgtcatcctccgtaaacggcgtcatggcggcaggcgcccatttcgatcccattttataaagggacggggatgacgagccgagcccgaaggctttcatcgccagtttttcgctgatcggcgctttgccctctttttccacaatgttctgccgatgcttgagcagcagctcgtgcagcggaattttaaccggacacgcttccgtacaggccgcgcataaggaagatgcgtacgggagctccttgtattcgtcatatccgccgagaagaggcgataagacggcgccgatcggacccgaatagatggacccgtacgagtgtccgccgacatgccggtacacgggacagacgttgatgcaggcggcgcagcggatacattgcagcaccgattggaattccgtgccgagtatgcgggaacgcccgttatccacaaccacgaggtggaattcctcaggcccgtcagcttctccttgctgccgggggcccgtcagcgccgtaatgtaacttgtaagccgctggccgaccgcgcttctcgtcagcatgctgacaagcacttcaaactcagaaaatgacggaacgatccgctccattcccatcacggtgatctgcgtcttcggtagcgcggacacaaggcggccgtttccttcgtttgttacgagactgaccgatccggtatccgcgattgcaaagttgcagcccgtgatgccgacatccgcttcgagaaattttttccggaggacgctgcgcgcgtgcatgacgagctcttccggtttttccgtctgtttgtattcgagtctctctttaaacacgtcacggatctgctctttgtttttgtgaagagcgggagcaacgatatgtgacggcggatcatgatcgtcaatctggagaatgtattcgccgagatccgtttctgtgacttcacagccctcttcctcaagcacttcgttcatattgatttcttctgtcaccatggatttggattttacgatttttttggcgtttttctgccggatgacatcgcggatataggaggacgcttcttccgccgtttcggcgaaaaagacatgtccgcctctgttggcgacattttcggcgagctgttccaaatagaaatcaagattgtccagcacatgctgtctgatttcttccgcatgggaacgccaatcctcccagtttcccaattcctcggccgcctgaagccttcttgtcctgagccgttcctgcgctccggagacggctcctctcataaactcattatctattccttctgatacccgctctttaaaagcggcggtaccgattttcatcgccatgattttacccccttgttgtttctcgtcttatctgctgttcagcacttcggcgatgtgcatgactctgacgtttttatccttacggtcaagacgcccgccgatattcatcagacatccgcaatccgccccgatcagcacctcggcctccgtgtcttccacgcaggcgaccttctcatccaccatttgttcagagatttgcgccattttcacagaaaatgttcctccgaatccgcagcattggtgctttccgggaagcgcggtcagctcgagccccttgacatggcgcaaaagcttcatcggctccgccgacacgccgagcagcctcgtcatgtggcatgatgtatggactgtcgcttttttatgcagcaccgccccgacatcctccaccccgagaacgttgacgataaaatccgttaactcatatgttttgtccgcaagctgctgcgcttttgcggcccacttcggatcgtcctgaaacagatgcggatattcacggaacatcgtcgtacaggaacctgacgggctgacgacgtactccgcttcttcaaacgcggcaatcatccgcttcatcgcttttttcgcatccgtcacatacccgctgttgtatgcgggctgcccgcagcaaatctgcccctcgggaaaatccacctcgcacccgagccgttccagcacctcaaccgtcgcctttccgacattggtctgaaacatatccacaaggcacgtgacaaataatgagactttcatgatgaacccctctttcatcctcagtatgtgatctggtcatctgatgacctgtttttggaaagctctatgaatatcctacactattctgaatatggattggaaggtttttctgaaaaatcctttcgcccgatgcgctgaagggtgcaaaaaaagagaagcctgaaagcttcccatgctgctctacatcccgtttttcagcaggcgtcccagtttttgcacaccctcttttatcgcggctttaccggcaaaactgaacgacaggcggagatattcggcaccgtcttcctgatgcggaaaaaaatattttccgggtacataggaaacgccgtgagacagagccctcgccagcattgcggacatatcagcccccggcgctttcacccatacaaaataaccgccttcaggcacgtgccaggatgcggattccggaagatatcgcgctgatgcggcgagcaaaacatcacgtttgcttcgatatgcttcccgcaaggcggcgagccgttcttcaatattcgtttgttccagatagacggcggtcaccgcttgggaaaacgggtggcctaagtctttttttaaccatgacaatgccgtgatgaatgcggcgtcccctgcaatccagccgatcctcatacccggggcgatgacttttgataatgaaccggcgtacagcacccggccgttttgatccatggctttcaagggcggcggaatatcggtgaatccgagctcgccgtatgcatcatcttccaagatgagaaaatcatacgtttcggcaagctgaagcaggcgggttctccgcttcgctgacattacggttcccgcaggattctgaaaagcgggtatcgtgtagagaagacggggaagcacaagcccttttcgttttctttcctcaagcatgaaggccaatgtttctgtttgcaggccctcttgatctgtcggaatgctcatgatatgcggtgtataattttttaaaatctcgagcgcttccatatagaccggagcttcaacggcagcggcggtttgttcatcgaggaaaacccgcgcagccagatctatcgcctgacaggcgcctgatgtcacgatcagctcatcgtcccggcagtgaatgccgcggatggctaaccgttcttgaatctgcttttttaaaacggccgtcctcgggcttcccatataatgcagcggcagatcgcgctcctcatccagaaggcgggaggcggcttctttcagctccttatcaggaacgagtgcgggatcgggatagccggagtgcagagggatgcacgctttcggaactgccggcatccattccccgggaggatcgtttgtcagagctttctttacatggtcagaaaaaaaagattcggcctgcatgtgatgctatcccctttcacaagtcagcttctatacattttcttcaaaataagcccccagcacttcttccacattcgtcaggtgcgccgtcatcgcggcttccgcttcatccgcgtctccggcggcgacggcgctgtaaatgcgttcatgctcttcatacaatcgctgcacgctcgttcgtttagaaaacagccaaatttttctcgtttctctcattgtttccaaaaggagcgcggagacatgattcatgagatgcttaagcagcccgttttgtgatgcttccgccagcgccatgtgaaaggagaaatctgctttttcgcccaattcttcgtctccgtcgatgtctttcatctccaagagagcttggcggattttttgcaaatcgtcttcggtgcgtttttcagcggccatggcggcgacgccgagttcaagcagctttctgacttcgagcagctgtttgacgtcctcttttttcatcaagagggcggaagaaagcggctgggaaacatgagacggctcaaattctcttatgtatgtgccttctccctgcttcatgtcgacgagccccatcgctttcaaagccgacagcgcttctctgaccgccgagcggctgacctgaaaactctcagaaagcgcctgaacggaatcaagcttttcacccggcttaagctcgcccgcttttatcttctccagcaatgcgtcagcgacttcttcgtagatttttttcgttttaatttgtttatatttcaacgcgatcaccccgtcacttgtgaatcttgatgtttatcgtctattatacttctttttttgtgttgccgacaggttcagacaatttgttcaagaaaagtattgtactttcaaaactttcaaaatataatgctaattaacccggtcatcagatgaccttatcataaaaagtaatcgtttacatgacataaggaggggttttttagggatgcaatggacacaggggtacgctcctttagggggaaatttgcttttatcggcagcttgcgcgctcgtgccgattatcttctttttttgggcgcttgcggtgaaacggatgaaggggtacatagcggggcttttaacgttagccgtttcacttttaatcgctgtatttgtttacggcatgccggcggaaaaagcggtgatgtccgcttctcagggagcggtgtacgggctgcttccgatcggctggattatcgtcacatcggtctttctgtataaaatcaccgtgaaaacgggacagttcgagattatccggagttcggtgctctcaattacagatgaccggcgtttgcaggcgctgctcatcgccttttcattcggggcatttttagaaggcgccgccggtttcggcgctcccgtcgcgatctcggccgctttgctcgtcggacttggttttcagccgctgtatgcggcgggaatttgcctgattgccaatacggcgcccgttgccttcggtgcgatcggcattccgattaccgccgtcgaaggtccgaccgggataccggcaatggaaatttcccaaatggtcggccggcagcttccgtttttatccgtctttattccgctttacttaatcattttgatgagcggttttaaaaaggcttttgagatatggccggccattcttgtttccggcgtctcctttgcggccgtgcagtacgcaagctcgaattttttagggcctgagcttccggatgtgctgtcggcgcttgtttccatggccgcgctcgctctgtttttgaaattttggaaaccgaaaacggcctttcgtttcgcggcagaacgggaatcagcagcggccgctgaccgggcgccgatcaagtacgggggcgccgcggtgtttaaagcgtggtctcctttccttcttctgacggccatgatatccgtttgggggattcccggcgtgaaggctgccttaaccggtcattatgaaggaacgtcaatgtggctttcctggctgaatgcagccgggcgcgcattgaccttcacgcctcccgtcccatttgtaaatcagcagattcttcaggcggacggcacgccgattgaagccgtgtacaagcttgagcttctcggttcagcgggcacggcgattctgattgccgccgtcatctccaagttcgccctcggcatgtcgtggaagacgtggggcgaagcgtttattgaaacggtgaaagagttaacgtttccggttgtgaccattgtttctgttgtcggctttgcttatgtgacgaatgcttccggcatgagcacgacactcggtctttcgcttgccatgacgggctcgatgtttacctttttttcgccggtgctcggctggctcggcgtatttattaccggctctgatacatcggccaacctattgttcggcggattgcaaaaggtgacggcgctctctgtcgggatggacccggttctctccgttgccgccaattcatcaggcggtgtcaccggaaaaatgatttctccgcaatccattgcggttgcctgtgccgctgtcggtctggcgggcaaggaagccgaccttttccgctttacgattaagcacagtctgtttttgcttctgctcgtctgtctcattacatttttacagcatcatctgttttcatggatgatcccgtaacacggagaacctccccggggtttggctcggggaggtttcagctgtaccgttttctcgccgatgacggcggaatatttaattgatcacggtatttggcgacggtgcgccttgagattcggatgtcatattgttcatgaagcagatcggcaagcttttggtctgaaaaaggtttctttttatcttctttacggaccaatgcttccagatgcgcttttacggcataattggaggcgccgccatcccccgatgattcagctttcgccgagaaaaatgttttcatttcatacagtccgtacggcgtctgaacgtacttccctttgatggcccggctgatcgttgattcgtggagctccagcgtttgcgccacctctcttaaggtcagcggctgcattccgctttttcctgtgagaaaaaaggattcctgccgttcagtcaggacgccgataattctcgtgatcgtttgttttctttgcgacaaagcccggttcagccagcgccattcctgatattttgccgacagataatttttcgtgtcacggcacccggcagctgacaggagcggctgataatgggcatgaagctggatgtcaggaaacgaacggctgttgagccgcgcttgaatgatgccgtttttcaccgtgatgaaaatatccggttctacgtaaaaacccggctcctcatgcgcataacggagccccggcctcggatcaagcgcgctgatcatgtcagcgatgccctgaatgtctttaagcggaatgcccgttttcagtgtaagcgctttccagttctttctggcaaatagctcaaaataggcttcggcaatccattccgcctgttcgttacgctcgggcagacggcggagctgaagaaggatgcattcctgcaaagaccgggcgccgattcccgcgggctcaagggattgaagctttttcaaaaccgcttccgtctcctcttgtgaagcggatacatggtcggcggcggctgatatgtcctcttttaaatatccgtttgaatccaatgaatgtatcagataattgaaaatttttttctcatcatcggacagcttcatgtctaaggcttgctgtttgagcgaatcctgcagggttttacgggtaagtctgatctgctggcttccgtcccgttctttcatcctgtttttatttgttttatggtaagatagtggcggcgtgtctgtttcctttcgttcaatcagagggttttccagtgagagctcatcaatatatccggccagttccgcggaattgtatccgagtaatgtgatggcctgtttaagctcttgcgttaattgaggctttaacatttgtgtttgctgaagtttgatatccatcatgctcactccccttttttcattgtacatgattggtttcataccgtatatacttattaaaaggagttgctttatagatgtcagaacttttttctgttccctattttattgaaaactttacacagcacattgaaatgaatccgaatgaagaccgaattcatgcgatgaacagctattaccgctccgtcgtctcaacccttgtacaggatcagctgacgaaaaactcggttgtgctcaaaagaattcagcatttggatgaggcgtacaacaaagtaaaacgcggagaaacaaaataaaccttccgctcattcaaagcggaaggttttccttcgtgccggcggtttcaccgatcagccggacgtccggcgcttcgtgcgtccaggtgtaataatagttggcatttttcccgtatgaattatcaatgacggtattcggtttcccgagaagcgaggacaggatgtggccgtggagccttgacgtttccaccgattcgtacctgctgaaaaacaggaccgcttttttcgttaagaaatcggaatagcgtttccaaaaccgcgcaatcggcagcgggtttcccgcttttttattcaaaacattcagcgtttggaaaaaagcgattcccctgcggtcgcttgctgacagaacatcctgccagtcacagtttttaacggaagaattgttttgcagcttcgggttgatttccccatctgtgcggataaaatgaagcctgccgcgtgacggagccgctgacgccgcgatcggatacagctgatgggccatatcaggcataagcccgatatgattcgccgaaaaaaagtgtttcgcagtctcgtatgacacatgatctctcgtaaacaggtggagatccttgtgctccgcaaaaagcgccgatgtcttttgcagccgtgtctcatcctgataataaatcgattgcggcaggatgacgatcctgttttccggaaaggatttgacgattttttccctgaacgtctgatagtacggatagagatccccgaaatttccgccaccctgacagacgatgatcgtctttttgtccgcccggcgcccgaatggaaaattgtcgggattccagcgctgtcttacgcggatgccgtgcgctttaaaaaacgcctccgtccctttcataatcaataaatcccctacatttccgtagaggggatagtcggcatatatgatgtcggattgcggcggtataacgctgagcagacccgtcagcttctcttttaatcggctcataacatggcggctgtccatgttttctcccctttcgtttcaaacagttgcgcaagtgcgtcaatgacacgctgctgctcctcagaagacaggtcagacccggacggcagacagatgccccggctgaaaaggttctcagagacacgctcatgttcgctgtgaggataaaagacggaagatgagaaaagcggctgcgtatgcagcggtttccacagcggccgggcctcaatgttctgttccgcaagacaggcaacggcttcttgcggcgtcacgccgttatcaagcgtcagagccgtcagccagcggtttgaaaccgttccttcaagctccggcatcatgcggatgcccggatatgtttccagcgcttcccgataccggttaaagatttctctcctcgcccggacgcgatcttcgagcacttccagctgcgatatccccacgcccgcgagaatgttgcttagcctgtagttgtaaccgagctcgctgtgctggtaatgaacggcggcatctctcgcctgtgacgcaagaaacctcgctttttcaatcgcggcttcatcgtcagacacgagcatgccgcctcccgatgttgtaatgattttgttgccgttaaaggaataaatgccgaaacggccgaaggtgccgctctgcctgcctttatatgttgatcctaaggactcggcagcgtcttcaatcagacagacgccgtatgcgtcacaaaggctcattaattcatccattttcgcgctttggccgtaaagattgacggcgatcaccgctttcgggagtctgccgcgccgctttgcatcccggagcgcccgctcaagcgcagcgggcgacatattccacgtctcccattccgaatcaataaaaacgggctcagcctgctcatacacaattggattcgccgtggcgacaaacgtaaaggaaggacaaaatacaacgtctccttttttcacacccgcaagccgcagggcaagatggatggcggccgttcccgagcttacggccgccgcgcttttcactcccgcatattccgcgagccgcgcttcaaacgaattgacgagcggaccgagcggggcaatccaattggagcggaaggcttctgcgatgtattcctgttcttttccgctcatatgaggcggagacaaataaatccgtttgtttgtttgcatgaaatcatcctttttcattatggataggggggatgacgcgggccggaacgccgaccgccgtcacatggccgggaattctgctgatgaccgcagcccccgcgccgataacggaccaagggccgatatccatctgcggtatgacggacgcgccgattccgatgtgcgttccttccccgacattcactccgccggcaagcgccgcgcgcggtgaaagatggacgtaatctccgattgcattgtcatgatcggcaaccgcccccgtattgatgatgcaatgggcgccgatgtcagcgcccgcctgaatgacggcgcccgccatcacaaccgttccgtgtccgacggaagccgtttcactgacgatcgccccggggtgaatgagtgcagcataatctatatcttcaatcccaagcgtttcagcaaactgctttctgacgccgttgcgtccgatgcatatcgtgaacacggcctcggggacgagtttctgaagtatgtgcacgtcttccgtccggcccgtatataaaccgttccgaacggcaaaaccgctgaatccgtcgtccaatatgcccgcaagctccatatcggaacgggcctgcacgatttccttcacgacttttccgtgtccgccgtttccgatcagcacgacctttttcacgatgacatatctccgctgcctgtgaagcgctttgccgtcacatggccggcttggtgtatgccttctgacacgagaacttttttcactgttaaaagcagaatctttaagtcgagcagaaaggtgcggttgtcgacgtaccacacgtcgagcttgaatttctcctcccatgaaatcgcgtttctcccattgatctgcgcccagcccgtaatccccggcttcacctcgtgccgccgcgcctgctccgccgtgtaaagcggcagataatccatcagcaaagggcgggggccgaccagactgatatcgcctttgagcacattaaaaagctggggaagctcatcgatgctcagttttctgatcagccttcccggtttggtcaggcgcagatgatccggaagcagcacaccgttttcatcacgcgcatccgtcatcgttctgagtttatacaacgtaaacggacgcccattatgccccggtctcgtctgtttgaacaataccggagacccgatggcgcatctgacggctgccatggcgaagagaagaatgacactcgcgccgcacaataacagcatcgcggccgctatatcaaatacacgtttcgccttcaaatctgaacagctcctttcacttttcggcatttctgtaaagcaagccgcctttcttctttcgtacaaatgaagaaaaaagcgaatgcggcatagcttatgcatacggcaagccccgcggcgatcagaccggcccagctgtcaagcggtgaaaacagccggataccccggcagacggcccaggcaaatacggccgccgccaacggtccgaacatgcctttgtaaaacgcggttttctgaaagccggtaatatgcgaaacatacagcggcgtgaagacggcatttttcaaaatgagggagacagccccggcaatggtgatgccgtacagcccgagatgtgccggtccgctgagaaccacggccaatatgacattcagtccgcctaaacataaagtaacgacggcgggcgttttttgtttattaaaagccgtccatacgtaaaaaagcggcatgacagagagactgaccgccaaatacgcggcgtgaatatataaaagcggcgccgtctgcacaaacgacgggcccagccaaatcgccagaaacggttcggcaagccctcctaataatgcggcgggaagcgcgaggagaagcccgttcatccgcacggccttattggcgtaagacaggagaccttccatatcgccttttgaataataggaagtcaaaaccggcgcaaacagtgaagcaagcgtcccggcaagacttctgagcagaagcgggaattgaataatcgccgcatagacacccgcttcagacggccccagcacgaggttggccgtcatgaggtcaatctgcagaaacagcagcacgccgatctggttgacagaactccaggcaccggccgaaaacagcactttgctcgtctgtaatgacaaggttttacggctgaaagaaaaccatggaatcaatttcttaaagaagaaaaaagtcagcacagccgcacagacggctcccgctaatgccgaaagctggatctgccagatcttcggcggcaggcacgtaaacagagcgagcacacacagcaccctgaccagcatttgcacggcctgaatggaacttgtgatataaagcttgttggcaaaaaacggccccgtcgcgaaccccgccataaaaaacgtcagcataaacagcacgctgccgattacgatagacagcctcacatccgttaagagcccggccggtacattcataatcttgtcaataaaaaaagcagtcccggcgagcggcacagcgagtaatagagatatcacgacagaagcggctaaataattgcttacatacgcattggcctcgtccctgttccccctgtgggcggcgacggagaaaaaccttacaacgacagagctcagcgcaacggtaataatagagaaatagttaatgatattctgtgtcagatggacaaacccaaaggcctcaacacctaatgttttcacaataaagggcgtcatccacactgataaaaacaccgatagtaaaaacgccgtcacattggtgccgaaattaatggcaaatttcatgctccttccgcactgcctttctctttcgatttccgttcgaaaaacgcatgcagaagaagaggaaggcgcattttgcacagaccgagcaccacgcgctccccggccagcagctgtttatggcggcacggcgtcctgcgcacggccgtttttaccatgtcatacgttaagattctgccgatatgcgccgtaatctggtgtgacggctgcggggcggcgcatgcgttggcgatcagcatcggaatctgatgcttgcacaaatatgtatcaatatcgctccggcaggcgtccgtcagcccgtttgcctcataaaaagccattttcgctgcatattgcttttgcagttcgtgatctaagcggggcttaaacggtgtttctgtaagactttgcggattttcccggtagatatacagcccttcgtctatcactttgacacgcgcggcttggcggaacgctgccaagttaaacggagagtcctcggcaaaccggatatcttcatggaacaacagcccttgcaatgcttctcgccggtatatatagcgccacacataccaaataaaccgatgttcgtgcgcgcgggtcagcaatgcggtcatttcatccgctgtgaagacgcggcccggcggaagggacggcggcatatacgttctttctttagacggcgtttctttgtaataaccgcagccggcgatatccagccggttcttctccgcttcttcataaagccgctcgaacattgtttccgtcacataatcatcgccgtccgcaaaaccgatataacggccgcgggcggcttttattccggcattgcgggccgagctgaggccgccgttttctttatgaatcacccggattctcgcatcttctgcggcgaattgttcagccatccggcctgactgatccggtgaaccgtcatcgacgaaaatgatttcgatgtctctcagcgtctgttttgttaaagaaaccgcgcattctttaataaaaggctctgtcttatacatcggcacgatcacgctcacaagcggcgcggtcattgggcatcaccgctgattttcgagcgcagcccggcaaaataaacacttcgcaaagaaccgccttcctcatgcttgccgctgagcagccggtttacggcggacgttacggcttcagggtcgggacgttcaagcaatatcatgttcggtatgtttttcagccattgatagccttccatcaccttatgatcaaacgaacgaatgacgacacaaggcgttttcgtcagcgcacaaaaaatcatcccgtgaagcctgtcagtgacgacggcttccgcgcctttcagcgtattccaaagcgcttccagctccttttcacgtgtatggcggctgaccctccggccgaccgtcgtggtaaaggaatacagctctccgtactctttggccaaagcttcttttaccatcgttctgtcctcagccgtcagcgcactctccttatcctcccgtaaacagaggtagatcccttcccgcgggatgccccgctcgcttttatccaaatataagaccatgtcaggctgtttgagcactgtttttccgggaaaatgacgcttcatccattgatacgtcgtctcatctctcgccattaacaaaaggtcgggatgcgcattgtacacttttcgggcgcgcttcagttccttccgtcccttttttgattcagaaaagtgagccgtcgccggaagctgaacgatccgatattgccggaatgtttttatgataaagcggcgcgtccattcctcataccggtacaaatcccccatgttcccgccgccgatgatgaataccatatcatcggggtggcgctttttgatcagcgcttttgccgatctgtatatatccttcatatccacctcgacaatgtcaaaatcgggatactcccgttcaagaaattttttgcttgcgtaggcgatggcgtgatcgccgagattatcgtgggacgggagcagcgtcaaaatgatcttttttcttgccgctgtaagccccgccccatccgctcccgttccgaaatgaaattgggacgggtatttgaacttaagcaaaagccattccgcgagattgatttttaaagattgtatcgacatgtcttcaccctctgattttcattttgtactcgattgcccgctgatacgcggctgatgccagcgacacgaacggaatcagcttcagcttcgccaaaagcagaaggcatgagcgtttggcgtcaaacggcgccgttcccgttttggaaaggctcaggcggaatacgggatcagcgcatatccggctgatattcttccacttctcagaaaaccggcctccgttattccgcttccattcattcagcaggcagaccgttccgtgctgaacgatgaaaaaatccagctcctgccggtattcctgtaagcagccgttttcacgcaaaaaagcctcgttcagccgatagagaacgagacctgagtcaaacagctttttctgatagctttgcacaatggaagtcaagtgaatccgataatgatagagcggctgatccacgtatgagacggcacctgcgaaaacatgcgcccggaggctgaagtactgatcctccacgtgctccagctcatcacgaagcggaaagcgcagctgatgatgctcgatcatggatcttttgtacagcttgttccatgaaaagccgctgactcttccttcaaataaatctttcaggtatcgttgtttcgggcggccctcgtacgctgaagcgatcgttgaaacggcggttttccccgtatccgcaaattcagccgcatattcgcaaatcacgagatcagcctgatcagccttcgctttttcatacatgctgaggcaataatcaggttcaacccagtcgtccgcatcaataaaagcgataaattcgccgcgcgccgcctcgattcccctgttgcggaccgcgccgagcccccggttttgctgatgaacgaccctgattctctcatcccgcttctgataggtttcaagaatcgccgggctttgatccgttgacccgtcattaacggccacgatttcgatattggcgagcgactgattgagcaatgaatctaagcatctttctaaataagtttccgtattatacacagcaattaataaactgaccgcgggtgtttccatataaacctccagtgtccattaccgggaaaaaatcgttctgtacggaagcacagacgaatcgaccggcataagcaagtaactgtaaagaaaataacagacaataatggcgatataaatcagcgcatttgatttttcatcaaaaatcctcacaaaataagggatcaagatcatttggtacaggccgaaatatatattaaaccgggcaaaaataacatcctttgtcgccaaaagaccgaagagcaggccgagcagacagaaattcacgatgacatcaatgtcaggccagagattccgcagccgctcccgatagcagaaagccaaaaacagcggcagaagcagcaccgcgatttttacgacgttcatcccgttcgtattggtcatcagccatttctcataatggccgtacgagctgttttccagcacgacgacaaacagcgaaatgaacttctgatacagaaacgtcataagaagaaacaatgccgacagtccgaaaatcgcgggcgaccatgctctttttctgacgagaaaataaaccggaatcataatcagcgctgaggaatgaaaaagcgaacacagcagcacgattgacatataacgcttccagcttccgctgatcacgtaacggacggcccaaaacaaaacggccgccaccatatactgcctgatcccgttaaaggaagcgtaatagtgatacgtgcccaaaaacaaaaatacactcagctcaaacggacggccgaactcaacgagcccctttaaaataaagctgcacgtcacgaccgccacggtgaaatacatgatttgcggatctttcgtgataaaattcatgagccagatgagagccgtaaaccccggatcaacggctgcttttttcgctccgaacccgaagatctcccaaatgctgccgtaattttccgccagcttgtacatcagcgcgtacgtctgaaaatccgtcccgactctgtagcgcaaaccggagaccaataccagcgatagcaacggaacgagcatgacgagctgattcggccggtatccggtcgaaagcgattgatcacgcccgccgcacattttcgcgaaccatgaccaaatataaacaattcccatattgactacatatacaatcattcgttactgttcctttttccaattcatattgtaaagcttcataacagcccccgcattttctcccgcgtcatatcccagccgcctgagggtttctttaatacgcgtcccgtcaggctttgccgcctctgctgcccgtaaaaccgcggatgcccattgtcctggcggttctttgaggctgagccttttgaccagcccgagcccggcatcggcttcttccgttatgccgtctgatatcacgcacggcaccccggaggcctgcgcttcaacgagcgtgacgggcagcccctcataaagagacggcatgacaaatacatccagcattttcagcagatcatgaacgcggtcttctatgccgataaaacgcacatcatcatcaagccccagcttcgccgccagattttccatatcggtgcgaagcggaccgtctccggcgagaaccagctgtaagccgatgccccgctctttcatatcagcggccagccggagcagaaattcgtggtttttttcttctgtaaagcggccgatatggccgatcaccaaacggccgtctgcaatgccccgcttccttttttcagcttctgtgtccgcccacccgccggcaaataagtcgagatcaatgccgttcggcaaaagatgcacgtctttttctttcccgaataagaaacggcccgcctcttttccgcaggcgcacagtgccgtggcgtttgccgtgatcagccgtctgaacacaaacagctgtatcccggcaagccgcgacgcccgcccccgccacgacgtactgtgcgaatggcagatccgcaccgggacgccggctaaacgagcggccaatgcgataaatcccgactgaaaatcggtatgggcgtgcacggcggcaaacgggcctttttcctgaatcacccgcttgacctgttttacaaatgtaatcgggtttgtgctgccgatgctcggcacataaaaaagccgtccgccgagagcgagaatttcctcatcataagcgcacggatcgttcctatgggttaaaaaatcaaactgcaccttcgttctgtccatcttccggtacaaattcatcatcatcgtttctgcgccgcccctgttcataccgctgaagatgtgcagcacccgcatcggtttgtcagtcatgttcggcaagcccttctttttggcggatgtccctgtttttatgataacggttcatgaccgcgggcggcgtaatggcgcggatgagcggttttgcgatatacgcgtaatgggaaagcggcagcttcagccgtctgcatgcctgaaaaacgagcaccgcattatcaatggaatacgtaaacgatctccttttaaacgcatcactgtcctctctgactttatacagcgtttcctggagattgtacccacggaaacccgcttcaaaaaagcgcagccacaaatcgatatcttccatccgccgcgtccgcctgactgaccggtagccgccaagcgctttgtacgcttcagcccgcatcataatggtgccatggcagaacggtgtgcctttcgccataattcccggtttcggcacgggcggcaaaagccgggcgcccctgacgccgaattcgtcaaatacgagcatgcccgtgcctacgacttgatagtgggcgtgcttgtttaagaaagcggcctgtttttccagtctcctcgggttggagatgtcatcaccgtcctgcctggcgatataatcccccgttgcgtatgtcagacagcggttcagcgaagcggcaagccgttgattcgtcttattttgaatcagcgtgatccggtcgctgtaatgatccgcgtaacggcgcgcaatctgatacgttccgtcagttgacgcgtcatcacacataatcagttcccaattcttatacgattggctcaggatggattcaatactctccgctaatgtctcttcgcaattataaattcccatgatgacggaaattttcggttgtgctcctgcattcatacgcttttctcctttttatccatataaccggcgtaaatgtgcgccatttcctttaccgtacgtgtttctgaaaaacattccgccgtcctgcgcccttcttgtcccattgcttttcgcagacccggggatcggtacagcttttcaatccgatcggcaaatgccgcgctgtcccctgccggcacgagaaaaccgttcacaccgtcttcgatgatctcacggtggcccctgttgtctgcggcaacggcgggcttttcggcagccatcccttcaagcagattcataccgagcccttcgcggatgcttgaggcgacagacagatcggcaagctgaatcagctcatgaatgtcacggcaaaaaccgtaaaaccgcacaatgtcggataccccgagtgattcagccttttttctgtacggttcttccatcgcgccttctccggcaaatacgagtttcagctccggaatgcggttcttcagcaatgccgcagcctcaatgagaagtccctggtttttattgccgtttaattcagcggggtatatgaggataaattccccggcgccgaagccgtgtttttctctcagacgttcactctctgcccggctcacagggcgaaacctgtctgtattcacgccgatgccgtgtattttcttcgcgccgcaagctgtttttttcatttgcttggcccgttcgtaatcctcttcattaatcgtaatcaaacaatccgtgtaagaagagagaaatttttcgatcgggtaataaataagccagtttttcaggggcgctccgtcgcagaagtgaaagccgtgcgcggtgtacagcaccttcgtccctttttggcgcgcttgtctcgccgcaaggcgtgcaagcacgccgccgaccggcgtatgacagtgaatcatgtcgtagccgttgtcctgaatgagccgtttcagccgcctgtaaacagaaagattttcgggatgaaacggcgagcgccggatcgggatggaaaacttttcatcaacgaacggaagattcatattgccgcctgccgcgacgtgcacctcccagcccatatcctgaaaccattgaaaatacggaagatgaaaggctttaaaatgataatcgacagtggcgcagaataatacttttttcgtcatctttctgtcctcccatcacacacctgcggccgcttcttcatgtactgattcgatcgcctcaaacagccgttttctcagctcatcttcaggcagacggctgaattcctccataaaacggatgagcacggcccaatccccgtcgatcgctttcccgatatggattttcggaaaaatctgttccgtatgtacttcattatgattcagcagttcttcatacatcttttctcccgggcggatgccggagaattcaatgggaatctgttctgtcgtatagcctgataaatgaatcaagttctttgccaagtcgacgattttgacgggttctcccatatccagaacgaaaatctgccgcccctttgcaagcgcccccgcctgaatgacgagtcttgacgcttcggggatcgtcataaaatatcttgtcatcgccggatgcgtgacggtgacgggtccgcctttttcaatctgctttttgaaaatcggaatgacgctgccgcggcttccgagcacattcccgaaacggacggcggcgaatttggtgttgctgacctttccgaggttcatgatgaccatttccgcaaaccgcttcgtcgcgcccatgacattggccggattgaccgctttgtcagaagaaatcagcacgaatgtttccgttccgcacatatcggcggcttcggcgacatttttcgtgccgataatattgtttttgacggcttcttccggattatgttccattaacggcacatgtttatgggcggccgcatgatagacgacgtgcggctcgtattttttcatcaaggtaaagattttatctctgtcctgaatatcggcgatctccgcatgaaaaagcacctctttgccgaagcgtgcggacagttcgttatgcaccgaataaatgctgttctccccgtggccgagaaggacgatttcatgcggaagaaacgagctgatctggcggcagatttcagaaccgatagagccgccggcgcccgtgaccagaatcgttttccctttgatgctgtcagaaattttgctcgtatcaagggtgaccggctttctgccgaggagatcttcggctttcacatccctgatgtgtccggcagcctgcgttccgagcaggatctcatcaaattgcggcatgattttaatatgggcgcccgtctgtacacattctttgtacagcgtctgaagctcatgggtgcaaagagacggaatggcgatgataatgtggtgaattctcagcctctgcaccgccggcataatgctttcttttccgccgatgacgggcaggcccataattttgagcttatgcttcgtctgatcatcatcaataaaagccacaggcatgattccgagatcgtttttctgggtaagctgacggacgagcagcgttcctcctgcgcccgcgccgatgatcagcgcccgggaagagtcattttgcttcctgccgatcgtttctttcagtacgcgcgaaatcatccggcttcctccgatgaacaatagctgaatcatccagctgacggctaacagccggaataaaatcgtgtggaacaccccgtattggacggcggctgtcacagctgcggacagcgtgatccccttcagcagatcaagcagctcgcctattcccgtatacgtccatacctgcttatactggtgaaacataaaagcgcatacatgatggctgatcagcatgcttacggcagtcagcagcaacgctccggagtcataaaagtgataagaatcctcaaaaaattgatatcctataacaacggaaagtaaaacgagatacgtatccaatgcaaaaatcattgaaagtcttctccggtaagtcaatctttcccctcctcatttatcggtttagctgatacggttttcgtaaaaacagacataacagctaagccgataacaatgcatcatcttaagataaattgggcatttaacccgtcctcacaccccgccaccgacgaccagcatctaaggcggcggaaaacgccgcccacagcagagccgagtgcctccgttgataaaggtaaggagacatcacctgcaccgctcaatacgagtagtgctctgtttttttgattttctttttattcagcagcgcccccaaaagctttgccttagactgctgaagcgcgtctttcgccttttggacggtatccattttcgtttttccgctcaagacgacgagaacgcttccatctgtctggttcgctaaaatctgtccgtccgccaccgccaaaagcggaggtgaatcgaaaataaccagactgtaccggctgtacatctcctgaatcagctctcccatcgcctttgaagataaaagctcagccggattcggcggcgtcggcccgctcgttaagacgtaaaggttatcaatcagcgttttttgcaccgtttcgccgagggaagcgtttccgactaacacattcgtaaggccttgtacattttcaagctgataggtctcgtgtatcgtcggttttcgtaaatccgcatcgacgagcagcacctttttttcctgctgcgcaaataccgcggcaaggttggcggcgctgaatgactttccttctcccggaacggaggaagtgacgagaatggagcgcaaatgggtctgaacagaggagaactcaatatttgtccgaatggtgcggtattgttcagccaccaatgatttgtgatgtaaaacggatatttgagccagtccccttcttgatttcttttttctgaatcccaaacgcctcactccccgaaatgtttttcatcagaccgtgtctgctgatttttgatgtcatacacaacccctaaaacaggcaagtctgttttttcgctgagctgccgctcgcttttaacggtttcatcaagaaagtggagaaaaaacgcaagcgtcacacccgccatgagagccgcaccgaacgccatcatgatattcctgatgcgcgaaggcttgaccatcgggctttccgatgcttttgcctcggacaaaacaatgacgccttttatattcatcctgtcacggacttcttttttaaatgtcttcatcagcgtgttcgctatagcggcggcctgtttcgggttctcgtcctgcaccgctacggtaatgatctctgaatcggtttcgctgcttgtcgtgatctttgcttttaaagcggatgccgtctcagaaagatgcagcttctgtttcactttctcaagcacaaccgggcttttcattatcgtttgaaacgtattgttgtaatgaagattcagctgaacgtcgctgagattcgaatttttttcaccgcttgtttcatgaatgagcacttgggtcgatgcctgataaacgggcgaaaccacccggaattggatgtatcccgtcaccagcgttacaactgctgtcatgataaaaatcagtaaaagtctgtgtttaataatgtcaaataattctttaaaactcatattctcattcatgtaattacagcctcatccttattgcatcaggcttaaacgcccccttctgttaatgattggattataaaagaaaaggtcgaaatttgaaaatttcaaattaagccatttggttctttttagagaacattatcatgattttcctcttatttactgcacttcccttataattttaaattttataaagaacgaaaaatttcttataatgaacaaaaatgccagtatacaggggagaattcagcacaatgattggaagaataattcgtttataccgcagaagaaaaggctactctattaatcagctagcagttgaagcaggtgtctctaaatcttatttaagcaagatagaacggggggttcactcaaatccgtccatccaatttctgaaaaaagtatccgccaccctgcaggtcgatctgacggagctttttgatgccgaaacgatgctgcatcagatgggagacacggaagatgagtggcgcatccaccttgtgcaggccgtccagtcgggcatgccgaaagaagaactgttcacctttacgaacaaactgactgaaaagcgcccggagcccgcaccctaccgcaacagaaaactgactgaatccaacattgaagaatggaaagcgctgatgcaggaagcaaaagaactcggcttgtccgttcaggaagtcagatcatttttagaacggaagcgttactgatgatatgctgatgaaagggcttttattcgcttcatgccttcatctctgtttataatgaaaagaaaaaaggggatgaaatcatgacaaaacttaccgttcaaacccgctgcggcgcactgaaaggaactgccggccgcggtgcccgcacatggaagggcataccgtacgcgaagccgcccgtcggagagctgagatttaaagcgccggagccgcccgcaccttgggacggcgtaaaacatgccgattcgttcgggccggtttgtccgcagccggatgatatgctgtccatatcgttttccggggatataccgcctcaatctgaagattgcctttacctcaacgttttcgcccccgattcagagggcgaaaaaaagcctgtcatggtatggatacacggcggggcattttatttaggtgccggaagcgaaccgctttacgacggatctgcccttgccgctgacggagatgtcattgtcgtgacactcaattacaggctcggaccgttaggctttttacatttgtcttctattcatgacgcgtattccgccaatatcgggctgctcgatcagatcgccgcgttgcgctgggtgagggacaatatctccgaatttggaggagacccggataacgtcacgatatttggtgaatcggcaggcggcatgagcatcgcctcacttatggcaatgcctgacgcaaaaggtctgtttcataaagccattttagaaagcggcgcctctcatacgatcccggcggacatggcaaaagacatcgcggcggcatttattcatgaagccggcactgatcaattgcaggagctttccgttaatgacctgcttaagactgcggataaagtgcggcgctcactggatcaaaacatttttcagcttttgtttcagcccgccatcgatccggccacattgcctgcggaaccggtgaaagccatagcagacggggccgcagaaggcatacctatgatcatcggaaccaatcgtgatgaagcatatttgtttttcacccctgatacagacattcattccgagaaaaagcagcaagattatttgcattattacctcggagaaaactgcaccgagcaagcggcagatttatatccgcattcattaacgggacaaatcgatatgatgacggatctgattttctggcggccggctgtcgctttcgcacaaggacagtcgcaacacgcaccggtctggatgtaccgctttgattggcatggcgaaacaccgccgtttcataaagctgttcacgctctggaattgccgtttgtgttcggaaactttgattctttgagaaagacgctgcaagagccgctcggtgatgacgcagaacagctttccaaacaaatccaatccgcatggctcgcttttgcaaaaaccggaaacccgaacacctctcacttcaattggcctgaatatgaaaccgattcacgcgaaactttgcttttcaacacggataccgctgtcgaaagtgatcccgattcagcaaaacgccgcatcctgtttcaagcctaaaaaacgccaagggagccggctcccttggcgtttcattttcatcttacttcagacatcagtcagcttcgcggcatatccatttccgcattacccctgatatgttatattccaacccaatacgttaaccaaacattcataaaggagtttttatatggagaaatcaagtattatcggcacagctgccgttataatcggggcgcttatgaccttagtttcatttatcttcctgcgcgacactgatttctatgccgtgaggtggataggggttgttatcatggttgcagggttttcatgcggtccggcccacaccatatcaaaacataaaaacaaacatgaaaaagaaacccggtaacctttactgggtttctttcatacctttcattttatctcacttcataatgcaactccgcaaattgtttgtaacgcctgacatcagtcagcttcagtcctgtctcccggtctccgggtttaaacaaagaaattccgcggccgagcagaacgggggcgatctgaatgataaactcatcgacaagtttttcctccaaaaccgggtgcagcagatcactcccgccgacaatccaaatccgcttgccttcttggcatttcaatgcttttataaaatcggcaggctcttcatgaataaaccgcacatgttcagtacgccctgtcaatgtccgcgaaaacacatagcattctttacctttgtacggaaattcctcaggcaataaaaccaatatttcctcgtatgtttttctgcccataatgatcgtatcgacagattcatagaaagcttcataatcggtgctgtcttcaccttcagttccgattaaccaatctaaagaatgattttcccgcgcaagatagccatctgcgctgacagctccgtaaaaaacgagctttctttgaccgctcataaaaatccctccccttttttattataccttaaacatgcgggtgacatgaaaaatgatagaatcgggtaaaaacctccgttaccgggttttcgtttcttcctgctttggagatgctgttaatatgccgtctatccatcttccggtaatcggcataaagaaatgaaggatgatccctcctaaacaaacggttaataatgttccgatgcctaccggaccttttagcatcacggccagtatgaaaaatatgaagtaaatgactgttcttgaaaaaaagatgcttctcccggttaattcgcggacaattaacgttaaccgatcaaccgggatcggtgcgaaatttgtgtgcaggtaggttgcggttcctatccctatcacaactaaaccgattgcaaaacagcccgcctttccgtaccatagttcaggcgttatgactcgatgcagaaaaaaaagccacatatcaatcccgattcccgttataaacgccgtaatcatccctgaaaattccggtctttgtctttttaacattgaattacagcaaattaacaggaaagcgatgatgatttcccagcttcccacggtaagccctgcatggacggacaatcccacaataagcgcatcaaaaggcgacgttccaagatctgattgaatcgtgacagaaataccaaaggtcaagatcatgattcctaaaacataaaaaacatatttcactttatcgtcctcattttctaattttatgttgcaaatacaacaaaattacggtatgtttactatacggtatttttattgcaaacacaacaaaaaaaacagctgatatgataaatgaagaaaggagctgtatgaccatgagtattaaattaaaaaagtgcagccttaacgatataacagagctccgggagataagcattgaaacattcaatgatacatttaaagatcaaaattcacctgaaaatatgaaagcttatttggaaaatgcattccgctctgaacagctgaaaaaggaattatccaatccgtcttctcaattctattttgtttattatcatcatgaccttgcggggtatgtaaaagtcaacttgaacgaagcacagtcagaaaaaatgggggaagactctcttgagattgagagaatttatataagaaaaagccatcagaaacacgggcttggcaaatatctgctgaatgaagctgtgaaaatcgcaacagcacacaataaaaagaacatctggctgggcgtatgggaaaaaaacgaaaatgcaatcgccttttatcaaaaaatggggtttgtccaaaccggagaacactctttttatatgggggatgataaacaagtcgactttatcatgaccaaaaccctgtcgtaaaaggatacaaaaaacccggcaagctgccgggtttttctcttattttaattttcccgcacggatatcatcggtcattccttcgtacggcgcttctgaaatcaatgtttcgttattgattcccgcattgttgagatacgtaatatccgcaaactcgggaacgacatatttcgggtacgtttcatatttctcacgtgactctttcatcacgtcaatgtaatcattttggtagcacaccgtgatttccggatgctcatgcacccatttcgggaagaaaataattccgtgcatccgtttttcattcggcataaagtttaaggaaacgtctgtgcctgtcggttcagtccatgacactttgtatacgccttctgtcagcttgacgatattcacttcctggtcgcgcacccagcggccgcctaccattccgctatgaatccgatagtcgatcgtatgatcatttttaatatagatttcatactcccagccgttttcatacgtgtaaatcatatggcttccgataaagttttccatgttgactcactctccatcttattattgaatttcataaccgaatgtcatccggcaatctgaccgcagccccgataaacagccggtcctgcagatgctgatatgcctcactgcttgtttcaaacacaggcacagtgcggaaatacacgtgctcgggatcaatgatgcgtttcactgactcataaatgacttttttaaagaaggttcattcaaggacgtatcacctcccgagacattatgtttgtttaaacatgtaactatttacatgattaattgtaacgctgttaaaatggactgtcaaataatgagctgtttccggttatgttttacagtgttcaataaaaaaagacaagggcggcacatgccgaaacccttgtctttttcattaagctcatctataaaaaacgcagacgagcgtcttcttagtaatcacaatctttatctctgcatcctttcttacttacagcgtctattgagtgccccatgatcttgtcatttgctttatcataaataccatcaaatttattcgatgtatcaccgttgtaatagccaaatacctctatcccgcccattggatctatctcgtatttatctttaaatgtaacgttatgtatgccttcataattcgctttgataaatttctccattcgttcttgcgcaatctttatctcttcagcctgaacatttttatcattcatactcttcattataaaacctccggctgctattaagataatgaagataataatatattttttcacagaatcatccgtcccatcagttatgatgaagctcgcggactagaaaaatggtggtgacatccgatgcatttagggtcttaagatttttcttccgcatccgcagaggagctccctattttgtcacctacaggatcatataaaccgtcaaattctttagttttatcgccgtttagatacccctcaactgtaattccgcccgttggatcaataaaataatcatcataagaaattttctctattcccttgtactcgtgatgcaagtattcggtcattttacttttggctttttcaaaaagagccttttcttcctttttcacatcatattgatgcttcataatcaatcctccaacagttatagttaacaccgatacaataataaggtattttttcaaaaaaaatcatcccttttcctaccctattttacatgacaagaaaggtgctatataaacgtgcttataactatgactatcttaaaaggaaattagtgaacaatgagtatatacgtactaattcttccatttcaaaacctacttattggtacgtcgatcaaataaaatcagacgatgatacagggctcgatgcggttgtattagtacaagcagtgaagaaaaacggaaaatgcgtaaaatcaaaaaaactcgaaaacgtggtcgtccccttttcaggaaccgaaatcgcaaaaggcccgatctttgacggcgggaatattgttttcggaaataatccgaaaacagaagtgtattattttgtaaaagaagatacggaggatacatcgaacggtcggaacctacaatagtaatttgcccacctaaatatttgatagcttaatattgcagtgcttcttggacttcccctcatggtttaagtaaacgtaactactgaaaacttgatatgaatatactttcagcatgtcaaaagcaaagctaaccaattcagaattcatcgcgattgttactgacaagttaagattggaacttaaagcgagtaaaatgctgatctgacgtttttcctaacgttgagttgtcatgatatttgtacgcggttatcgttaatatcggggatacctcgacaaatgagacggtagaggcgattgatctcaggaataggtttgaactgtatgagaaacatatctcgaatcttgtaagataattaaacaaaataaatacccactcatcctgaggtgggtattttatctttcttcggcattgaccactgaaatacctatctccttgttcgttggatcatatataccggaaaattctttttctttattattatttatgtagcctgaaacttcaactccgcctgtcggatcgatattgtagtcttttgaaaaatgaacttcctgtacatttttatagtctttttttaagtaaatcttcatgtgctcttgcgcctcaatcacaagtttttcttcgtttttatgtttatcatattgacgcttcacgaaaaaacctcccactgctataattataataattaggataataatgtattttctcatgcgtatcatcctttcggaactattttacaatataagaaaggtgatgtatatatgccaaaaggaaaagaaataaccgtctctaatgtcacagataaagaatattaccgtttgagtcaagcagcttataattataaaatgttagccctgcatatgaagtaagacgtaatattggtacgttgagaaagcgcagcaggattctgatacgtggcttgatgcctttgtattctcaaaaggcatcaagccaaaaagcagaaaatggatcaaatcaaaaaaccccgaaaacgtggtcgtcgcctttgcgggaaccgatatcgaaaaagacccgatctttgactgcgggataattgttttcggaaatgatccgaaaacagaagtgtattacaaggagaaaaacaagaatggctactctttaaggaaagggatttatccgttagagtttttggggccagccaataatacaaaaataaagacgccagttaggcgtcataagatttttcttccgcatccacagaggagctccctattttgtcatctggaggatcatataaaccggcaaattcgtttggtattacattattcaaatatcactaaactgtaattttgccagctaaatcaataaaataatcataaagaattcttctctattccagcgtctttttagtattcacattctttttcctgacattcgggtttctcttctgcatcgactgacgaaactcctatttcatcattcgttttgtcataaagtccgaaaaattctttttcattattaccattcaagtaccccctaatagaaattcctcccatatggtctattttgtaatcgttatcgtatgtaatgtgttttatatttttgtaattagcttttatatagctttccattttatctttcacttggataaaaagttcttgctctgcttcttttttatcatggtggtacttcatgtagatacttcctgacactatagttattacaaatatcaggacaaccatgtatttcttcacagactcatcctttcttagattaaatttacatcaacctcagggtgttgtacatgtctaaaaaacatcaacgtatcaagtatcagtgatcgagaatacttttttataagcgttagttatagttagatctaggttaaatgaagtgatgaaggagaagggtattcaaagccaaaagggtttggctgatttagttggttctactgaggttacgataagcagatttaaaacaaatacaagatatgatatcacaacactattcattattaacagaggattaaatgtatctatggaaaatttgttttatgcccaggagattagaggaagagcaatacagcaaaattagcccagctcgattgagcaggctaatttatcttgtacaaagcttatctttacattcttcttttggttcggcatcaaccgtatatgataatatttctttattgcctggatcatatagaccttcaaactctttttttccattcgtataacccttaatactaataccacccattgggttaatatagtaatcctcggaaaaatggatattatccacatttttatagttcgttgttaaaaacttttccatatgattctgggcttcttcgaataacgcaatctctttttccttttgatcatactgatgcttcataaaaagtcccccaactgctataattattaaaataaggataattatgtactttttctttttcatttggaaatcaaccctttcctatcttattttacaaaaataaggaggcaatgtatatgaatcacaagattaaagttccaaaattaacagataaaatttattatacgctaagtcaggaatcttacaaccacgaaagattagttgataaattgaaaacggggaaaccgatacaaacagaccaacaaacttattggtacgttgaaaaaataaaaacggacgaagataccggattagacgcagttgtactatcacaaggagaaaaaacacaagatggaaaatgggtaaaatcaaaaaaccccgaaaacgtggtcgtcgcctttgcgggaaccgatatcggaaaagacccgatcaatgacggcgtaaaagcggacggcgggaatattgttttcggaaatgatccgcaaaaagaagtgtattatattgtaaaaaaagacgcggaggatacctcgaaaacgctcggaacctatcacggaacgccctctcaagacgccatgctcacaaccggaaagtataagctgataacgaaaacatcgcaaatcgatcaagccgatcagctggtacgcagcgtaaagaaaaagtatgccggaacgtcaacgattatttcaacaaccggccattcactcggcggcgctgaggccgaatacagcgcagtgaataatgatgtgtacgccgtcgcgtttaacagcccctccgtcgtcaaactgcacgatgaagaaacacagaaagacatcaacagcggcatatacgatccatacatccggtccattatcaatccggacgacatggtcggggcaggttattggaacgaatatgaccgccacaacgggacaacgatttatacgaaaaacccctcactctcacagttcagccggaagcagcggcttggcgggaacttgaacgagcagatcagcaagaatctcgcttatttcttcactacggtcattctgagaaatccggatacacacggcttaaacgaagcgaatttcatatttgaccgaaacggaaacatcacaaatccgaatggtgatgaattagttttcgataaaaacctcggcgctctcctgccggccggtgcgatcggaagcggagacgcgataaaagtaacgccgaaaaacgcaaagaagctggctgaaaaggtgcaggccatgactgaggatttgcggacgatgaaaaaagaagcgcagaacgcctatcaagagcacgatgaaaaaatcgccgagctgaaaacggaattttacggccaagttgggcatggcttgtttgatcagcttcaagcacaggacgtgaccaatacaattgaagatattgcgcaatcctacgataaaggcccgattttttacgacacacaggctgagcaggcgtttattgattctttgcaggcggcgatcacggaccttgaagaggtcggcggattcttacataaaatagcggacgaatttcaggaaaaagaccagatgctcgcaaactggttaagatgatagaggtggatacataatgccgacattagacgaacttttagaacacaaggacgacccgatgaagaaaaggctgcagcggcagatgctgaaaaccgccatgacgcaggcagcggagacaaaactggagacagtgcgccgaacgctgaaaccgacattcgaaatggatacgttgaaagatgaattatatgaagtgtattcagccttattgaacagcttcgaaggcaaggcgcaaaaagctctcgcacagcggatcagtgaaagtgcgcggctgattgccggaaccgaaaataacagagacacattcgttaacagtttcaaaacaagataaaataaaaaaacctcgcagattatcatctgcgaggtttttcctatcgtcttaactgagacgcgctcggagggattcgaacccccgacagacgtggtaccggaaaccaccgctctatccaactgagctacgagcgcacgttttttcaatcagatacctttatattataataaagaaacgcacagaaagcaactcttttttgattatacacaacaggattatgcagcgtcctcatgcagcataatcctgcatcatttaacggcattgattttcacaaaaaacttatttcaggcggacgcccccggctcggtgcatttccagccgctgcagaaaaagcggcaatcactcgtttcagctttttttccaaatgtcttttaacgtccaataggtgaattcctcaacctttacggcgcctttctcagaaaacagctcaatccccaatctgccctcattcggatagatacggcttgtcatcgttgtttctccatgattggcgaatacttcaatcgaggatctgtcaataaagatacgcagcgccagcttgccgtttgcatccagccgcacccttctcacaccgtctttcgttttccccatcttggtgcaatcaagtgtcagctttttatccgttagattgtatgtcagcacaagttcttcttcgtcaaggccgcgaattttaaaacctgccgtttcggcatcagaatcgtttacatcaaacacggctcggacttcaagcaggtcttcggacgtctttgccaagtaactccctgaaaccgatcgtccggcacattcccgatattccattttccgcagctgcttggtttcttccacgggattcatcaaaagtttatgatcatcacgcaaagtcagttctcgcggcaaagtcagtgcaccgcaccatccgtctgcttttgtcggcatctcagattcccacatatccatccagccgatagcaattctgcgtcctttatcatctaataatgtttgcacggcgtaaaagtcatggccgtgatccagttctttaaaagcgccgtgtgtaaatttgtttgttttattattatagtcaccgattaaatagccggtttgatgtaaattttgataggaatcaccgtccgcttcaataccctgtggcgaaatcagcaggacgtgtttgccgcctagttcaaagaaatcaggacattcccacatatagccgagattaccgtcactttgggcgagaacccccgcgtattcccaatcacgcaaatcaggtgaacggtataaaacgacccgtccgacattttcttttgaagagttgccgatgaccatataccaaacatcgcgatgcttccatactttcggatcgcggaaatgacgggcgctgtcttccggcggttccgcaataacggggttttcctgaagcttttcaaacacggtgccatcttggctgacagcgatattttgagtttgatagaataggtctttctcttgatcaattatattatgtcctgtatagatgagggccaatcttccatgatcatcgaccgcgcttcccgaaaaacagccgctttgatcgaatgcgtcgcccggagctaaggcaaccggcaggtgctcccaatgaacgagatctttactttttacgtgtccccaatgcatcggcccccaatgctcatcatacggatgatgctgaaaaaagacgtggtattctcctttaaactgaataagcccgttcggatcattgatccaattcgcccgcggcataatatgataccccaatcgatacctttgttttactttaccctcggcttccttcaaagcttcttccgcctgctgaattctatccatttgtaacatcctctctatccgattttttgcagacgctggacacgcctgctgttttgtttcgggcccaataaagtaaatatggagatgacggtaaaaccaaagacgacgattcccatgatgagataggtttgacggaaccccgcactgtcatataatcctcccgcaagcggcgacagaatcgacgcgcctgcctgagatgcgaattgaaaaccgacgagataaaggacggacgacagacgcgtatcaaaattggcagccaaatatttaaaaacggcgatcagcataatcggcaattccagtgcgtggatgagtttcattgatgaaatgcctacaggctcaactgcaattccggacccgacgatgcggaaagccattaaaaaccccgctaaaatcaaactgtttttcgctccgaacttattgacgataaaaggcgcaagaaacatcatgccggcctccaaaaacacctggaatgaattcagatagccgaatacttggttacccattgacactgaaggaaacaaagacgcatagtagatcgggaactgctgatcatatacgccgtaaatgcaagtcaccccgataatgtacatcataaaaaaccagaaatcttttaataaaaagagccgccccacatcttttaaccggaccgattccgctctgtttttctcatgatcggtcatttctattttcacagacatgataatggccgttaatatgacggctgaaacagaggcgatccagaagttgatattgggattgatattgaaaagctgccctgcaaaaaatgcagccgccgcccagcccagcgagccccacattcttgattttccatactcgaaatcatacttacggctgaccttttcaatgtacgtttcaatcgcgcctattcccgctaaaaaagcggctcccaaatataagcctccgacaacggcgccaagaaagacgttgtattgtaaaagcggcccatagacgaagatataaaacggacccgtgaatatgagaagacagctgatcataaacaatatctttttcttcagccccaatttgtcagagataaaaccgtaaagaggctgcatgcacagggcaaatacggcgtttacagaaaagataatgcctgtcgctgatccgtttaaattgatttcctgccctaaccaaatcgcaaataaagaatagctggaagaccaagtaaaaaagaaaaagaagaaataagcactcagtttccaatacagactttttgagcttttcatttgcaccgctcctttaataggaccttttaacagccgttttagagccgcatacttccttcttcatattcatcacatacatgcgagcccttagtaagcgcttactttacgccgctgcttgattccttcactttattgccgccagccatctctccatacccatcacttcccttcactccataaataaagcgctttcaaaaagaattgtatgtcaaccggtttcatatgtcaatcggttgacataacattttctgattattccaatcaaacaaaatgcaccctctttatatgaaaacagaaacatggaatgtccttgcacatgtcagcctgattctctaaaataagtgcgtgacggaaattgtaagccatttcagtaagcaggagggcacgggaatgaagcctaacattcatgatgttgcgaaaatagcgggagtttcatctacaaccgtttcgcgggtattaaataaccgcggctatatcagcgaaaaaacaaaagaaaaagtgtacaaggcgatggaagaaatcaattactttccaaacgatctggcccgctctttattccgaaaacgaaccaatttaataggacttatcatcccaaactccagcaacccgtttttcggcgaactcgcctttcatattgaaagcatttgtacgtccatggggtacaaactgctgctttgcaacagtttacatcgaaaggataaggaagaaaaatatttggagatgctgataagaaaccaagtggacggcgtgatcgccgtgacttacaaccggggaattctcaattatcacaagcaaaatctgccgattgtcgccattgatcattacttatcggacacgattccagtcgtcggctcagacaactatgacggcggaaaaaaggcggctgagctgctgattgaaaaagggtgccggcacatcgtccatctcaacggcccgattgaactcgaaacaccggcaaacctcagaagaaaagcatacgaagacgtcatgcataaacacggacggaagcctattacatatgaagtacccttttatcagcattaccatgatattatttcaacattattcgatgaacagcctgacaccgacggaatttttgccagcgatgatatcatggcggctgccgtgatgaacgaggctaaaaaacgggggaaagacatcccgaatcaattaaaagtgatcggttatgacggcactgaaaccgttcaaacggttctgccggacttgacaaccatccagcagccgatcgaattgatttccaaaacagccatcgagattttagcaaaagaaattgaaggcgaatttgatgatttgccgctggaaacgtgtttgccggtacggcttttggaaggacggacaacgtagtcagaccgttcagccgtatgtaccgacggaactgcggtctattttgagcgctccggccatatcattttctcaaggctccggcgctgatcatcctcatttccactttgctgtttgaactttttgttttatgggaaaaatggtgttagaagaaaaggttggcattttggtcagcgttttgtttgacctttattgaccaaaaatgtatcatgtaaatacatacttacctaaaaggtgaaggaggagcattatgaatttaatacctacagtcattgaacaaacgaaccgcggagaaagagcttatgacatttactcccgtcttttgaaggaccgtattatcatgcttggatctgcgattgatgacaacgttgcgaactccatcgtgtcacagcttttattccttgaagcggaagaccctgaaaaagatatttccatttacattaacagccctggcggatcaatcactgccggtatggcaatctatgatacaatgcagttcattaaaccgaaagtatccacgatctgcatcggtatggccgcttctatgggagcatttttacttgcagccggagaaaaaggcaaacgttacgcgcttcctaacagtgaagttatgattcaccagccgcttggcggagcgcaaggacaggcgacagaaattgaaattgcggcaaaacgcattctcttgcttcgcgacaaattaaacaaagtgcttgctgaacgtaccggccagccgcttgaagtcattgagcgcgatacagaccgcgacaacttcaaatcagctgatgaagccttagaatacggcttaatcgataaagtgctgacacgcaatacggaagaccagaagtaatgcctcagaaacctgcaagagatgatgtctcttgcaggtttttttatgctttattcccattcaaaaaagtaatgaatgctttgacgacagataattctaacgctgaagaatcatacatgagccaagtatcgcgtatcacaggctcgttatttttataagacagcgccaatgtgtataattcatcagaaggctgaagacagatttccggcacaacagaataaccgaggccgtttttcaccatctctttacaggtttcctgcctgtctacctccattgcaatgaaaggcggttcagtaaattggttattccaccatttttgaatcaaacttttcaaagaagcatcagtttgataataaatcatcggcaatttgggaaggtcctcactgttgatttcagtttttgaaataaggtacagtctctcttcatttaacagttgtttttccccttgccaatcataattccccctcataatcccaaggtgtacccccgaatgatgaagcagatccatcacttttgcactccatcccgtattgacgtggaattgaacagacggatactgatcagaaaaccgttttagaatcgccgggagcttatactgagcaaaattgcttgagactcctaatctgagaaccccgctgacttcatggctcatattgagcatatcatccttcactcttctgaactcctgcagcatctctttcgaataatcaaccagatgttcaccttctgaagtgaactccatccctttttttcttttataaaaaaggcgcactccgaattgtgcttccaggtttttgagccgataacttaacgccggctgtgtcatatataatcgctctgccgccttcgtcatatttttttcttcgaataatgtaatgagcacaatccaatccttttcatccatatgaaatcccccaaaatatttttctgctataaaattttctcctattataaaagttttttattcaactttataaaaattatatgttttacttataatccttatttatcatacgatatcttccaaagggaccggtacctttttatccacacaaaatgatgtaaggatgagacagcatggaaaaagttcctgtaaccgttatgagaggcggcaccagcaaaggcgtttttattcatcaaaaagacatgccagacgatacaaacctatggagcgattttcttttagacattatggggagccctgacgagagacaaattgacggtctcggaggcggccattctctcacaagcaaggcagccattattaagaaatccgccagaaaggatgctgatgttgagtatacgtttgctcaggtcagtttgactgacaattttaccgacttcaaaggcaattgcggaaatatctcttctgccgtaggcccttatgctattgagaaagggctcgttcaagctgaagagccggtgacaaaagtcagaattttaaatacaaacactcaaaaagtgatcgcagcagaagtcgaagtcagaaatggaacatttcattaccagggggactgctctattccgggggttccaggtacagcttctcctatttatctttcatttcaccaggctgaaggagcggtgaccggtaagctgtttcccactggtcagcctattgatgttctcgataccccgtatggaaatatctcggtatcgattattgattacgccaatccgcttgtctttgtaaaagcagaggacacggggcttaccggcttagaacttccggatgaatacaccccggatatattggaaaagctcgaaatgatccgatcgattgcagccgagaaatgcagattcgctccgagacatgaggctgctgcaaaatcaccggccgtaccaaaactgacattaatctcatctccagcggattatatcgatacaaaagggataaagagacacgcagaagagatggatcttgtcattcgtatgatgtccatgcaaaaaccgcatcaagctttagccattacaggggcggtatgtacgactgccggcatgctattgcaagatacaatattatctgaattttcattctccggcagaacgatccgattggggcatccaagcggtattttaaaaaccgaggcagatgttgatccggacggaacaacgattaaagtagtacgcacagcaagaaaaatctctgaaggctatgtgtttactaaacaaagttacaacatgaatacgctgaatcacattggttaataccgtcttcagacaagtcaaagaaaaacggaggaatacgagatgatcaatgtaaatgcgtctaatcgattaaacagactgcctttttcaagggcccatcaagcagtgctcgttatcctttcattcgcttacttttttgattttatcgatttaaatacgttttcatatgcggcgccttcacttttaaaggaatggaacatatctactcataccatcgcttttattacgtctgtctcctatttcgggatgtttatcggcgcctctgccggaggatggttttcagaccgtttcggaaggaaaaaaggtttaattctggttgtcacctttttctcttccttctccctcctctcttctctggcttggaacccagaaatactcggtgtttttagatttcttacgagtttaggtatcggcgccacaacgattgtggcaagtacgtatatcagcgaatttttcccatccgcaactaagggaaaataccaggcaatctgtattacaatcggcatatgcggaattcctgcggccggctgggtggctaaattggtcgtgccgtccgcctcttacggctggcggtttatctttctattcggcgcggtcggtattttttttccgctgatcgccagaaaactggaagaatcaccgaaatggctggacacgaaaggaaaaagcgaacaagcacaccgcattctgcttgaactggaggcaaaagcagaaaaagaaaagggtgaactgcctgaaccagctccggctctgcaaagcagacaaaccgctgtaaaatccgttccatatcggacgctgtttcaaaagcctttggcaggaagaacttttgttttaatgacaatgtgggcagcttccacgattgcaattcaaggctttggcacgtgggttcccacccttctggtgaaagaaggcgtatcaatggatgagtctatcgtatacgtcactctgggaacgatcggtgccccgctgggcgctctcattgcgtcgcaaatctctgaccgtgtggatcgaaagtgggccatttctgttttatcgttaattattatggcgcttggattcttttacggcatcaatcctttgccgatggtcattatcgtatgcggatttctcatgcatatgtttgagcgtactttcagttcgatcgcatatgcttatacgccggaattatatccggttgaagccagggcatctggaaatggcctcacttacggcgtaggacgccttgcaaatgtagccggtccctttgtcgtcagtttcctgtattcaggctacggatttttaagtgttttcttgttctttacaggctgctggtttctttgtgcactgacagtcggtatatttggaatcggttcaaaaaaacaaaagatgcagcaggatgatttcatatcggaagaaacattcgtacaacaaaagttgtaaacgcatacagtctgcaaaccgcaaaacatccatctcctctgaggaaatggatgttcttattctttcaaccccagcagcattctcattcgcatcttattctcagccatatctcttattacgaagaaaggcgtggtacgcacgagaaagagaaaagaactttccgtcagaatgaatcagatgcagccgccgaaacatatttccgaccgctgccttacaattcacgccatttcttatctaaaatcgggtatgtataccgattcatctgctcaatcagctcatccggccgggaggaactgtgtatcagctttaaatgagactcattcgaaaatccttcctggatgctgtacttgaccatcttcatcatcggctcaaaatacccgttcacattgtacagtccgatcggtttttgatgaatgccgatttgcgcccagcacagcacttcaaataactcttcatatgttccgaaaccgccgggcatggcaatgtacccgtcggcaagttcactcattttcgctttccgctcatgcatgccgctgacttcaatcagctccgtcagattctgatgaacaatctctccgctgaaaagcccgctcggcatgacgccgacagcttttccgccgcctgccattaacgcatcagcgacggttcccatcagaccgacccgtgaaccgccgtaaacaaggccgattccctgctccgccatatattcacccagttcggccgctttgcgtttgtactcttcatttacccccgggtttgaccccgcaaatacacaaatggttttcattttttcatctccgcatctatatatgtacatcaataaatcaaaatacactatatattgtcccatctctatatgataatatcaataagaatcatacaggacataaggagtgtttcacatgcagatggctgaagcagaacaatggacgaaagatttttacgaaaaacgaggatggacggcgtacgggccatttatcagaatcggctttttaatggaagaggcgggtgagctcgcccgggcggtaagagcatatgaaatcggcagagaccggccggatgaaaaggacgcaacccaggctgaacgcagacaggagctgattgaagaaatgggtgacgtcctcggaaatctggctatccttgccgataagtacggaatcacgttagaagatgtgatgaaagcccatcaggaaaaactgatcaagcgctttgaaaccgaataaaaacacggcctgtccgctttttcatggacaggccgtatctgaatttatcccgttatctcgtcctgatgctcaaagaaatgctgtttcccgattttatgaaacagccccgtcttccggatcagctctctcggctgtgattgcaatccgacgatcatcaatctcccgttatgccgtttgatccggttcatcacattccccagcaccgcttctgcggaggtatccatgtaatgtacattattcatcagcagaataagcgtcttcggcttttcctgaagcctctccagcagcgatgattccagtgaatcaattgaaccgaaaaacagcggcccttcaatggaatatgtgctgacggacgaatcatttttaaccgatttgaccgcggcatgcggtgttttaatgcttgttgattcgctcatttttctgataaagaaaacaaaagcgagcacaagaccggcagaaacgccgataattaaatcaaacagaaccgtcagcaaaaaggttgccgccagtacgaatgaatcagtgtttttcagccgcatcatattggcgacttccctccgctcactcatgttccaagccacaaccatcaataccggcgccatgcttgccagcggtacgtgaacggcaagcggggcgaagacgagcaggacgaggaggacggtgactccgtggacaacaccggaaatcggagaaactgcgccgtttttaatatttgttgcggtccgcgcaatcgctcccgttgccggtatgccgccgaaaagcggcgctgccatattggcgatgccctgcccgacaagctccctattgctgtcatgccgtgatcctttcatattgtccgcgaccatcgccgataatatggattcaagtccgccgagaagcgcaatgatcagagccgacggaaacatcatcaccatgttatcaattgagaaatccggaagctggaaagccggaagctgccgcggaatttccccgtaagcagaaccgattgtcgccattttgtcaggaaaaaacacgaccgccgcggctgtagagacaagcagcgccacaagcgcgccgggaatcttcggcatcagcctggctgataacagcaaaatggccaaagcaattcccgcgatgaggatactgtacaaattaaaggttccgatcttcttgcctatttccgcaatgttgaggataaagctttcatgcttttggatatcgcgcagaccgagaaaatgggcaatctgctccgagaaaatcagcactgcgatcccggccgtaaatccgacgatcaccggcttcggcacgaatttcataatctttccgagcttaaatacgccaaacaggacgagcatgacgcctgccataaaaccggctacaagtaaattctcaaaaccatactgcatcacaatggcaaataaaatgggaacaaacgcccctgtaggcccgccgatctgatatttagacccgcccaacagcgaaatcagaattccggccacaataacggtgtaaagcccgtattccggaccgacccccgaggcgatggcaaaggccattcccagtggaatcgctacaattccgaccacaattcccgcgattaggtctttctgaaatttctgcaaattgtacccctggtatctgccggtaaattgcatcgtcagctgcatcctcctttgactgtttcataaccgtcaacgactacatccagcgtccccgttcccggatcgatcaccagcccgtgcaccggcacctcttcaggcaagagcggatgatgcctgaccatattcacgctgtgggccacgctttcttcgacgctgtgaaaaccggtcagccatgtttccaaatcgactcccgcatgctgcagaaggctcagacatttgtcctccacgccgcgctcttttgctttatttaatatggaagccgcatttaatcccgacattccgcactcgcggtgacctatgatgcagacttcctctgcctgcagttcataaacggcaaccaaaatgctccgcatgacacttccaaatgggtgagaaacaatggctcccgcgttttttatgattttggcatcgccgtttctgagtcccatcgcctgcggcagaagctccgtcagccttgtatccatacaggatacgatgacaagcttttttttcgggaattttgtcgtttggtaaggttcatatttcctttcttggacaaactgctggttgtgctccaaaatgcttgataaagaaaccatttttctattcatctcccatccgattgtattgcaagccttcttacccagcttacagtaaggaattatagcacagaaaaaggcctcaaaagcgctttcaaaaaaagacacgataatttaactgtaaattcagattatattcatttatatctttcaaaaataataaaatttatctttacaccaacctataaagcttttgaaaacagcagttccgctcattttgccttcagaaatataggcggattctgttactgtttggagaaatcaagcatgtacatttctttttctttcattttaagttcaaaagaaccagaaatttatcgtaatgcgtttgaatatttctcacgttaccgcttctcttatataataaaatagagaagaaagacaaaggaggagaagcccgttgaaaccctatgtattcatcgcgaaaccgataccgcccgaagtcgaacaaatgataggcgagcattgccgctatgacatctggaaagaagataccattccaaaagaggaactgtacgaaaaaatgaaagatgctgaagggctgctgacatccggaacggcgattgacagtgatttgctggatcacgcgccgaagctgaaggtcgtcagcaataattcagtcggctatgataattttaatattgaagaaatgaaaagacgcggggttgtcggcacgcatacaccgtacaccttagatgacactgtcgctgatctggctttttcattaattctgtcttccgccagacgggttgccgaattggatcgattcgtccgcgccggcaaatggggaaccattgaggaggaatctcttttcggtatggatgtccaccatcagacattaggaattatcggcatgggcagaatcggtgaacaagctgccaaacgggcaaaattcggcttcgatatggacgtgctgtattataaccgcagcagaaaaccggatgctgagaaggaactcggggttacatatgccgacttagatacactgctgaaaacatcagactttgtgcttttaattaccccgcttactgacgaaacgtatcatatgatgggagagcgggaatttaaattgatgaaagatacggcatgtttcgtcaatatttcccggggaaagacggttgatgagaaagcgctcatccgcgcattgcaggagggctggataaaaggcgccggtttagatgtgtttgaaaaagagccgatcgccgaagacaatccgctcctgcagctggaaaacgtcacattgcttcctcatatcgggtcagcaacggcaaaaatccgcttgaatatgttcaagcaagccgcacaaaacatgattgacgccgtatacggaaaaacaccgaaaaacctcacgaaggaatttcaatgagatgaaaaatcccggccgtttcagccggggtttatttttcactagatcaaaagtactattttaaaattctttctattcctttctcttgatgctgatacaatgaaaaggaatcagcttcacatgataaaaatgggaggtattgctttgaaaaaacgattatcgtggatttccgtttgtttgctggtgctgttctccgcggcggggatgctgttttcaacggctgccaagacggatacatcttctcacaaggcgcacactgaagcacaggttatcaacacgtttgacggggttgcggattatcttcagacctatcataagcttcctgataattacattacaaaatcagaagcacaggccctcggctgggtggcatcaaaggggaatctggcggacgtcgccccggggaaaagcatcggcggagacatcttctcaaacagggaaggcaaactccctgcaaaaagcggacggacgtggcgtgaagcggatattaactatacatcaggcttcagaaattcagaccggattctttactcaagcgactggctgatttataagacgacagaccactatcaaacctttacaaaaatgagataaacacatacaaaaaacggcttccctgcggaggccgtttttttgcagagaacctgcaagcttcatataaaatgagcagtaaatttttcttcaaactctgagcggtctattctgctgttttccgccgtgccatcgtgtttttttattgttatattgcgttcagacagaaccatgtgcccttccggtgtccgcttagaagcaagcaggcgtttgttgaaaggagaacgttcatgttcaaagattgtttgtttcatagacttgaggtccttttcatcgatttcttcaagcgaaaatgcgtaacctgtctgccagccgtcttacactaaattgaattatttcctgactagagtagaataaaacaacagtggtttaatattagatacatccttactcttcttaatctaatacaacagaacacatttcttaccatcatagcagtggatgaacgctatttagtactggtagttagacaataattctcttccatatatacattctgtgactaaattgtttataaactaatctattttcctgtagtaccatttgtagctaccaacttattattcacaattctaaccagactgccttgcttaaccattttccttaaagtgctgctatactgaacactactatatgaataatatttatcgaccgcaaggaacctcccggtttcattgttcataaggtccatttgtttatctatacctgaagactttgattcatgtgctgtagcccatacttttgccctgtcatatccatgattcggtcctccaccaaaggattgtactaagcgtgcattccaatagctatgtcgaaatgcatcaccattaccttgataaagttgctgcttaccagaataatatttattcgtttcgttataagcttcttttgctgcatttgcatacttagtgaactcaagtgggtttctctctgccaagcgaatttcatccttattcaattgcccaaagccaggaacagggatataataatccaatgctgaaaaagaagtagatttacttcggattgcttgttggatttctttagctgcaatctgattgagttcttcctctgtataatctttgttagaaatttctttattcaacttattatgtatcttacttaacatattaatatctgtatttctaacttcttgttcagttaaataaactttatctctttttgtttgatcaactgaatgctcaactttttcttttggattttcatgggctaaagccggggaagagtagaaagttactgcagagatagccacactcgataacagcaatacacattttttcatagttatacctccagataatgtattaacatcaaaattttatcatatagatagattgttatcaactatttttgtaactaatggtttattatgtaatatttaattctaagaattcataacactttcaatctttctatcaaaagtataagataaaacatccacatttatagatatgttattaagtatcgaaaataatttaaaaaagacaacctctgataatctgctcacaaattttttctcaaaaaagcttgcagagaacctgcaagcttcatataaaatgagcagtaaatttttcttcaaactctgaccggtctattctgctgttttccgccgtgccatcgtgtttttttattgttatattgcgttcagacagaaccatgtgcccttccggtgtccgcttagaagcaagcaggcgtttgttgaaaggagagcgttcatgttcaaagattgtttgtttcatagacttgaggtccttttcatcgatttcttcaagcgaaaatgcgtaacctgtctgccagccgtcccctttgttcatttcaagcaggtatgttccgaattccgtctcttctatcctcacgcggaacgctccggccgctgataccgtctcgtctcccgacatcggcacaggctgcatggcgagattgaggccgaatcctgcatcagcgatgtactcattctccccggcggaaagaagtacggccgcatgtgtgccgggcagcgcccagccgtttttccagaccgttccgcggatcaatttgacatcaaatccggcatctttcaggatgaaataaagcagtccgttcaagtcatagcaaaggccgccatgaggttccttcaccatgtgccgccacagtccttctttcgtgacgtcatattcttttttggacaaaacagcgcgattttcaaacggaaaccgatacgcgagcgcctttaaaaactccggcaggttgctgaaatcgagggaatccttttcccagcctatcgtttgataacaatctttcagaaactcattcatcgttccgtcccccttacaaagtgtttacacttcttcctgcacataagcggacaacttttccagcgcttccttttcatcgtcgccttcagcgatcagagtgacttccgtccccgtactgaccgccagactcattaatcccataatgcttttggcattcactttcttgccgtttttctcaagaaacacatctgatgcaaaacgatttgcctcctgtacaaacaatgcagcggggcgcgcctgcaatcccgtctttaaacgcacttccactttcccctgaaccataagatctccccttttctgtacggttatttcaaagtgatgctttgtcctgtacgcagctgttctgcgatttcatcgagctttctcagcctgtgattgatgccggatttgctgattttcccgcttgcaaccatttcccccagttctttcagcgtgacctcctgataatcaatccgcagctgcgcaatttcgcgaagcttttccggcagcgcttcaagaccgatccgttcatcaatgtatttaatattttccacctgtctgagagaagccccgatggttttgtttaagtttgctgtttcacaattgacgaggcggttcactgagtttctcatatctctgacaatccgcacatcttcaaagcgcagcagtgaattgtgagcgccgatgacattcagaaattcagtgattttttccgcctcttttaaatacgtaatatagccttttttccgttcaagcgttttactgttcagatgaaattcattcagcagcgcgcataatgaatcgttatgttccttataaagcgagaagatttccaagtggtacgacgaggtttcgggattattcacagatccccccgccaaaaacgcccctctcatataagaacgtttgcagcaccgtttcgccaccagttcctcagaaatattccgttcaaatataaagttctccccgaggattttcaattcctctaaaatcagctttgcattttcagaaaagcgcacaatataaacattgttttttttcagccgcattttttttctgactaacagttcgaccgatacatcatattgtttcttcagcaatgtataaatgcggcgggcaatcgccgcattttcggtttgaacgtcaagcacgagatggcggtttgaaaatgacagggaaccgttcatccgaatcagcgcggacagctccgccttggcgcagcagtccttcacttccagattcgtcagttctttttttgtttccgatgcaaatgacatattagccacctcatttcaaaaggcctctagtcccttaataaatcgacaagaagagaagccactttatgtgtatcgtgacggattacgccatttttatacgtgataatctgatccctgatgacctcaagccccatagatttcaacttttcaacattgaagtcgacgggccgggccagctctttcgcatatttgcttttgatttcgtcagggatctcctcattgttgattaagatcgtgtcgataaacggctgctccatatgatcgttcagcgccttgacatggtcggccgcgctgtattgaagcgtctcgccgggctgtgtcatgacgttgcatatatatacttttttggccgcggccttgacgacttcctctccgattttcggcacgagcagattcggaagaatgcttgtgtacaggcttcccggaccgataatgattaaatcggcctgacggatgacgtcaatcgtttccggcagcggatcaattttttcaggcgtaagaaacacccgtttaatccgctggccgtaagaagggattgtcgattctccggagacgacctgcccgtcctccatttcagcgtgaagaacgacactggtgttggcagcaggcagcactctgccgcggacattcagcaccttgctcatttcggtgacagcgtgaaagaaatcaccggttatatttgtcatcgctgccaaaatcaaattgccgagcgaatgtccggttaagtcgcttcctttgttgaaacggtgctgaaacagattttcaacgagcggctcaacatctgacaaagcggccagtacgttacggatgtcacccggcggcggaatttgaagttcatcccgcagacggcctgaacttccgccgtcatcagcaactgtcacaatcgccgtaatatcaacgggcttatgctttaacccccgaagcagcacggacagacccgttccgccgccgaagattgcgattttcggcttcttattcatttccggcttctcttttcaatgtcccggtgagtgacatgagtatagaaatcttttttaaaatagtcagccaaatactcagcgagcgcgacggagcggtgctggccgcccgtacagccgatcgcgatgacaagctggcttttaccttcccgcttataagacggaagcataaagccgagcagatcaacaagcttttcaataaacttttgtgtttcgttccacttcatcacataggatgacacttcctcatccttccccgtaagcggcctcatgctttcaatgtagaacggattcggcagaaaccttacatcaaacacgaggtcggcatctatcggaagcccgtatttgaaaccgaatgacatcacgttcactgtaaatgtttcaccttggttcgtggcgaaatgcgccacgattttttcacgcagatcacgcggtttcatacccgatgtgtcatagatcagctgagagcgccctttcaattcttcaagcagctggcgttccagcgcgattccttcaagaggaagcccggtagctgccagcgggtgagaacgcctcgtttctttgtatctcgtcacaaggatggaatccttagcgtctaaaaagagaatgcgcggtgtaatccacggattttccgccatttcatccagcgcctcaatcagcctgtcaaaaaattcacgtccccgcagatccatgacaagcgcgaccttgctcatttttgaacttgattctttcatcagctccaaaaatttcggcagcaaggaaggcggcagattgtcgacgcaaaaatagccgagatcctcaaagctttgaatggcgacggttttccccgctccagacattcccgtaatgatgacgagctgaatatcatggttttcattcatactcatctttctcccccctgcggtctttcttttatttgataagctgcggatctaaacgatagctgagcagctcgaagtccggcgtatacgtaaaggtgccgtgcaaaagcccttggcccttgatcataaaatcaaggatatgcccgtctccgggggccatcggaaggctgtggatatcttttacgtcatgccacttcagaacgccttcctctgattcagcgacattccgccccgtgtaggagtcggcgacgaaagtaaacatcatccactctgacacgatttgttcctgttccttaataataaaggtaaacacgccttttaactgcggatttagtatataaatgcccgtctcttctctgtactctctgatgacggaatctctgacggattcgccgctttccatcttcccgccgggcgcgacccaccagccccgtctcggcttttggagaaggagaacctgatcatctgtctgtagcacacaatttgtcactctttgcacaagtacgtcacctaaccttctcaacaaatcatcgtctcttcattataccgtttcggcatgtctctcacaatgcagagacaccgacatccttttcttttatttgacagaaaacaaaaaatcgcaaaaaaagggcacggatactggaatccgtgccaaagtgtattcattaaaaagggggtcaattactacattcatcttaaaacatcagtatttcacccgtgttacagcgtaattaaaacacagtaacgattcaaaaactgaacattacagtgattatttaacggttttgagcgtttcctcaagctcttccacataatgctgaacgctttgagccgcaatacttccgtcgcctgtcgccgttacgatctggcggagcgttttttcacggatgtctcccgcggcgaaaatgcctggaacttttgtctccatttgagcgtttgtttcaatgtagccttcttcatttgtgatgcccaagttctcgaacggtttagaaagcggaagcataccgatataaataaagacgccgtcagctttgaattcttcctcttctcccgtcacggtatccacaagagtaagcctgccgacttttccgttttcctcatggatttcttttacggttttgttccatttgaagtcaattttctcattgtcaaaggcacgcgcctgaagaatgctttgcgcacgcaatttgtcacgtctgtgaacgatggtgacttttgaagcgaagcgtgtcagatagacgccttcttcaacggcggagtctccgccgccgacaacgacaagctctttatttttaaagaacgcgccgtcacaaaccgcgcagtatgatacgccgcggccgcccagttctttttcgccgggaacgccgatctttttgtattccgctccggcagaaatgacgatggcgcgcgctttatattcttttgaaccggctttgaccgttttatattctttaccgtcaacgatttctttaatatcgccgtacgcatattccgcaccgaattttttcgcatgttcaaacattttattagaaagttcagggccgagaatgctttcaaaacccggatagttttcaacatcctccgtgttggccatctggccgcccggaattcctctttcgatcattaatgtggataagttcgctcgtgatgtgtaaacggcagcggtcatccccgccggacccgcgccgataatgatcacatcataaattttttcttctgacaccatgattcactccttttcgaaatggggcgcgccctatatgactaagaatccccatcaatcgtattccttacccatatcctattaaatctgagggcaattcgctatttttttgctcatttttctaagaaaccgtgattaggcagctcctgagcgggtatacaaataaagaaagagccttccgggatagaaggcccttgtcttattcattattgaacgacacgtcttacattaccgttgaaatattttttccaataagggttgctcatagaatcgatagatacaccatgcgatgtattatcgttcaggaacgttccgttgcctaagtagatgccgacgtggccgtttgttttatacgtgttgaagaacactaagtctccgcgtttcatatcagacgcactgacagctttccctctgttaattaaagtatctgtgcttgttccgctgacaggtccgaggttaacgcctgcgttagcataagcccagcgtacgaatgaagagcagtcaaaaatacggttgtcaatatcagattgagtgcgtccgccgccgaatttgtacggagatttacccacaaggcttgatcctacgctgatcgcgccttcaataccgccagaatttgaaataacagatccgccgtcagaatcatctgaaccgccgctgttatgagatgatccgcctgaagtgctcttcggtttgcttgagctgtcagatgaatcagatgatgttgaaacagccgcttttttcacagttttaaccgccggtgccggctggctgtcatctttttggttttggtcttcagaagctttttgcgcttcttcctgttttttgatcagggcagccgctgcagcctgctcagctttaatgcgcttctgttctttttcagtgtcagctttttggtttgcaagctgtgacgcttcttttttcagatcagagatagcggaagccgcttttttctgaccgtttttcgcttcgtcgaaaagcttgtctttctgatcaagctgtttgttcaggtctttttgcatagactcgagtttcgcaagatcatcttgaacttttttcagcttcacgttaagttcagcctctgcgtcttcgagtttcgctttatcctgctcctgctgtttgatcaggtctttatccgcatcaacgatagaagatactgcagtcgcacgggaaatgaagtctccgaagcttgtcgctcctaaaagtacatctatgtatccttgagaaccgccgttttcctgtaaagaacgaacgcgttttttcaggatttcattgcgtttttcaatacgcgcttctgtttctttgatttcttttttcaaatcagcgatctgctttttcgttttttcgttttcagcttttttatcttcgattttattgcttgtatccaacgctttagcgttaatgtctttcagttctttttcaatcttagcctgcttgtcctgaagcttagacaattctctttcttttgcttcaaggcttgaagccacctcagattgcttgctttcaattttcgcttttttgctgtctaatgtttccgccgatgcagtttttgtaaacgggatcaaaaaactgcttgtcccgatgacggaagccaaaccaagtgttaataaactctttttcactttttctttcctcccttttactttaaacctgttctcatttggaattctattatgaacatcaaagttacgctccctcacatacccgtgaggctgatgatttttatgtacgattctttgaatctggttaattggtatagattatacagcacatgtaaaataaactaatctcttatgtacgagactcattataccatcatgtttcgacaatttttattacagttatatttcaatgtgattgcaaatctcatattttgcaaaataaacggtgattacggcctgatttcgattcaaaaagcaaaaaaatacgtatgaatacctcttttttcggcggtaaagttctgttttgcccctttatgataaaaaaaagaaccgactctttatatagaaagaatcggttttattctaatatatcatctatttgtctgatgtatttcgaaagggttgccggggttataccgtaaacggcggccgtttcttttttcgtcgttttttcgccgtttgcttctttccatacgtatgcgatggctgcggcccatgcccgctcattctgtacggcagcggcggcgcggatatgctgaatgacgtgaaaaacccagcagctcatgacgtcagtttttaaactgtcggcttccgctttctccagaagcttgaccgtccgatacgtgaacagcgcgtcaccagagacgcctgaagcgcctttttcaccggaaagcagcagtctgacgaaatcttgttcaaacggtgaaacggcgcgttttaccgtcagaactttttcaagctggttccgctctccttcagcgctgctgatataataggcggcaagccgctgttcaagtgaagcaggaagcggttcctgccgctccgcccaaggcgcgggccggtctgattcgggaaattcggcttcggcctttttccaaatggtttccgcaaattctgtgcggcctgtcccgtaggctgaggcggcaagccagtaataaaacgtttcgtcgccttcgaacccgcttttgtaaagagaacggagccatttataaccgagatcatgtctgccgacaagcgcaagcgtcgcccccagcttatagcgctgttcgaataaaatcggatacacgttggcgagttttccgctcaattctccgactttttcatcttccctctcgtaatagcagaatacaaggaggttgcacagggcatggagattgccttcatttttctcaagcacttcgaataccgtctgtttcgctgttgtaacattgcctgagtaaaagtaagcgagcgccaggttgttgtatgcagaccaaagctcggggtaatcggccgtaatctcttcaagcatgacaaccgcttcatgaagctggccgctctcaagaagcatttttgcccggtcctgcctgatcagcagctcatcctggtcatagagcgattcgttttcacccgcttcgccgaaatccaaaagctccatcagattttcaatctcttcgctgaattccccgtccggatcggcatctgaataagccgccgcttctttgtatgcttcctgaaagagccccaaatgcgcgaaattattcgctttaaaataatgacactcgggcatttcttctttcaggttcaccaaaataaagtcgaacagctcatttgactgctggtagtggcccatttcagaataaatcacggccagccgtgacagcatttcggaatcattcggctcgaggtggacggcccgctgaatcagtttgctggcccgttttaaattccgctctttatatgcttttaagcctttatgaaaaaaatattgtccatcctgaagcagctggacaatttgcgcgtgctttttctgttcagaagtgtgttttcccacaaatatcctccgttttatacgtattaccgtcagtagtataccataaaacggtttcgcctcaatagttcaaaagacaggatcggcttcgttttttactggctggttcgaccagattttagctgtttttttcacgaggctcggctggaagaatgacgcggaaaagggttccttcgccgcgcttgctctcaacctctatcgaaccgccgtgcagctctgcgattttttgtgcgatggacaggccgagcccgcttccccctgcgtttctcgccttgtccgctttataaaaccgttcaaatacacgctccgcctgttcaggctccattccgattccgtcgtcggcgatttcgacagccgccgctcccggcagatcaacaattttaacggaaatgcggccgccttcaccggtaaattttacggcattgtgaatcagattcatccatacttggctgagcagcgcttcatctccgtacacatacgactcctgtaaatcaatgagaaactcaatctgtttggcagaccattcaggctcacaggtcaatatggtgcgccgcagctgtttgtcaatgcggaacggttttttttgtatcggttcggtttggcgttcaagcgcagtgagcttcagcagattttcactgatttttgataatcgttctgtttctgtctcgatgatgtgtaagtagcgcccccgctcctcatatgataaatccggttttttcagaagatgcgcgtagccctttaatgaagtaagcggagtttggatttcatgggaaacgttcgaaataaattcttgtttcagcttttccatttcactcagttccgcggcgagtgtcgacagttcatcagccaatttcgtcacggggtggtcccgttcaatcttctccattttccgggaagcggccgctgtgaagttgccgctcgacatttgcttgatcgtggcggtcagcgaatcccagatcgcatgatgtctttcacgtgctgactttgaaaaaataaacatcgttacaaacagcaggccgaaaacaagccaaagcgtcagaatctgctcggcgtacggcacaagcaaaatcggccatatgagaccgaatccctgaacgatcaggtgagccgccagccataagaatgcggtgacggtgagaaggatgatgatttttccagccgttctgaagatccgtttcattctgtcaccacaaaccgatacccgagcccccgcaccgtatggatggcaaacggatagtccttttccggaaaccgttccctcagccttttaacatgcacatcaaccgtccgctcgtcaccttcataatcaaagccccaaatatcttctattaattgttctcttgaaaacgtcttattcggataaccggcgagcttaaataaaagctcaaattcacgccggggcagcgtcaatcccgctccgccgccgcgcgttacggtgcgggactgcttatctaatgtgacatttccgatggtcagcagtttttcagcggtgatccggtaccgtttcagcaatgctttgacccttgcttccagctcaagcggctcaaacggtttgacgagataatcatccgctccggaagtaaaaccttgcactttgtccagcgtttcgccttttgccgtcagcatcaaaatcggaatgtccgtaaagctgcggacggcttcactgacttcaaacccgtccattttcggcatcatcacatccagtatgatgagatcaataggtgctgattcgatcagcttcaccgccgcttccccgtcttccgcttctgcgacgtcaaagccgctctgctccatcatgaggcggacaagctcacggatatggcggtcgtcatccgcaaccaatatgacagccatgaaaatccctccttctgcttttttgcctgtcttcttttaatgaatcgacatgatgtctattaaccgtcttattttttcattgtctcctgtatcgacagacactttttttgtatggcggatcatttcctccgtcacttctttcattacgccttgatcaatatcttcacgagactcccagcgcaaaggaacattgtatacctgaatggtgccgtcaccattgctgctgtaagtgactgacccatcgactaaccgggagcctgctaactgcgtaacatcttccggatagcgggcgctcgtatgatcgtcaggattgacgagtgctccggccggaatgcggcgaacgttcaattcatctatctgctgattttccccaagctgcagccagatgcgggcatattcaatttgcagaggagaataatctgccgacatgttgttcggttggcttttgtccgcagagatgtgatgtgaatctttgattacgggttcttttttttctgccgctgatgctgtttcagccttgttgatgccgctgctttctccggccggacttgaagaatggctcggctcttcatcgttaccgtccgtacacccggcagtcatgaatacgagcagtaaggccgcgtgacaataaaaaatctttgtgcgttttttcataattcaacccccgcttccaatgaataggattccggctgcaaaataaaaagcagctttttcagctgctttctattcataaagtcttgctttacacagctttgttttctaagtcggcattcagcttcagctgctgctccgcaaaatcgcggtacagcgaatgggatgccattaattcatggtgtgtgccccgtccggtgatttcaccctgttcgacaaagagaagctgatctgcatccacaaccgtggataaacgatgggcgatcacaatcgtggtgcggccttccattagaacttccagcgcctgctgcacccatttttcagattggctgtccagacttgatgtcgcttcatcaagcatcagaatgctcgggttgcgaaggagcgctctggcaatggcgatgcgctggcgctgtccgcctgacagcataattccccgctcaccgacctctgtttcaaatttcttcggtaagtcttcaataaattgcagggcgtaggccatgtcagcagcttgcctcagttcctcatcagtcacctcgcgttttaatccgtagcagatattgtcgcggatggtgcctgacattaacgggctttcttgcgacacgtagccgatatgctcccgccatgactcaagggaatacgcatcaatcggttcatttccgagcaggatgctgcccgcagtcggattgtagaatcgttcaagcagcttaaataacgttgtttttccgccgccgctcggtccgacgatcgcggtgactttgccggcctcaatcgtagccgtaatgtcttttaggatggtttgatctgttttgtagccgaatgagacttgttcgagcttaatcggctgatccgcgttttcaatggcttttccggtttggatatcttcttctttttctgcaagaatatgaatcatccgttccgttgcgccgacggatttttgaagctgtgtgaaaaatgaagtgatctggcccatcggcataatgatctgaaacaaatacaggataaaggcaacgagtgcgccggctgtcaattcaccggatgacacctgcatcccgccgtacccgatgacagcgaccagcgccgccattaatacaagtgtaataagcgggcctacgagcgactgcaccttcgcttcacgcagcccgagtttaaagagcgccatgatgcctgcttttccgcgtccgtattccgcttcttcagcgtttgacgcttttacaagcctgatttccgggaggatgtggtttaataatccggtgaatctcgccgtttcatcctgtgtttcccgagaaattttaaacattttccggccgatcggcactaaaatcaccgcagccagcggcacgacgatcagcacgagcaatgtgagcttccagttcatgaaaaataagatcgtcagtgacccgataacggaaatgattccggtaataaatccgctgatattgtttgtgatcagctcttttaccaccattgtgtcattggtgatacggctgatcgtttctcctgtggcgtttttgtcaaaataagagacgggcagtttaattaatttctgccacaacaaatcacgcagtcccgagatgattttctggccgctgtagttcagggcgtaggtggcgtaggcgcttaatgcggcctgtacgataaacacggctgcgatgattccgatttgcacgcctgacagcgacgacatggaaaagccgtcaacgagctgctttgtcaatagcggaatcagcaggctgacgagcgttgtcacaatactgagagacagcgcgaaggccagcataccgtatgatggttttgtttttttgactaatgaaaagaatgagctgaatttccctttaggttttggttgtttattcggcatatgttttcctcctatatcactgtttatactataacggatgtgcatgaacggaatatgaacaaaacgtatatttttgataaaaaccaaaataaactctattagtcaatattatcaaattcatctgcctccggttgcggaaataaggaatattttattgaatgtttaagtttgacagaataaaaacctcacggactctccgtgaggtttgttttactcagatgctgaatggcgtttcgcaaggacgtcaagcacgtcatccagaggaagcgactgctcacgcagaagaacgagcaaatgatacagcaaatctgccgcttcccattttaattcttcatggtcgcggtttttcgcggcgataataacctctgcagcttcctctccgacttttttgagaattttatcgacgccttcccgaaacaggtacgttgtgtaggctccgtcaggcatctccgcctgccgtttggcgattacgctttccagttcattcaagatgccgaaacgatcctgcgtgtctgctttttccgtggaaaagcagctgtagcttcccttatggcatgcgggtcctgagggctccgcaagcacgacgagggcatcttgatcgcaatcataacggatggctttcaccttttgggtattccccgatgtcgctcctttatgccacagctctctgcgtgaacggctgtaaaaccaggtttctttcgtttctatcgttttttcgtaggattctcggttcatataagccagtgtcagcacttctttgcttgccgcatcctgtacgatggcgggtatcagtccggcctcgtcaaaccgcagttcatctgcctgtttcatctcacattcaccccgtgtttcttcatataatctttcacttcttttatagatgtctctttgtaatggaaaatagaagctgcaagcgcggcgtccgcttcaccgactgtgaaggcttcaagcatatggcgcgcgctgccggctccccctgacgcaatgacgggcaccgggacggcacgtgagacaagctgtgtgagcgtatgattaaagcctgttttctcaccgtctgcgtccatgcttgtcagcaggatttcacccgctccccggctgacagcttcttttgcccaggccgtgacttcccgctcggttttctttctgccgccgtgtgtgtacactttatagcaatccgaatcttcgtcatactttgcgtcaatcgccgctacgatgcattgcgagccgaaaaactcagctccttccgtaatcagctcgggtcggagaacggccgctgtattaacggatactttatcagcgccggcgcgaagcattcgtttcatatcgcttaattgattgattccgccgccgaccgtaaacggaatcgccagttttgccgcaacttgttctacgacgtctgtcatcgtcttgcggccttcgtgagaggcggaaatgtcgagaaaaacaagttcgtcagcgccctccctgtcgtaggcttcggccagctcgacaggatcgcccgcatctttcagcccgagaaattgaatgcccttgacgacgcgtccttctttcacatcgagacacggaatgattcgtttcgtgatcatgcgtccctcacccttctgagcgcttcagccaatgaaaattgttttgtatacagcgcttttccgataatcgctcccgatacgccggcgtctttgaagcgggccagtgctttgagatcggcgactgagctgactccgcctgaagcgatgacgtcttttcccgttgcttttgcgagctgaacggtgctttcgatgttcgggcctgacagcatgccgtcagttgcaatatccgtgaaaatgaaggtttccgctccttcggccgccaattcacggcccagatcggccgcccttaccgaggatgtttccagccagccttccgtcgagacatatccgttccttgcatcaaggccgatcgcgattttgccgccgtattgtttcagcatgctcttcacaaatgccggatcggaaacggccgagctgccgagaatgacgcgatcaacgccttgtgataaataaccgtacacatccgcttcagaacggatcccgccgccgatctcgactttgatatcaagctgccgcgcaatgtcaagaacatgcctgtcgtttactttcctgcctgctttcgcgccgtcaagatccacgagatgaatccattcggcgccttcttgtgcaaattgcgctgccatgtctaaaggagagtcaccgtatatcgtttccttgccgtaatcgccttggatgaggcggacgcatttgccgtttctcatatcgattgccggatataatgtaaaagcgttcatttcttcaccttctgttccgctgccatttttgtaaattgcgttaagatcgccattccggccgtaccgcttttttccggatgaaactgtgcaccgaagacattgcgtttcccgacgactgccggaacacgaacgccgtactcagcgcttgccagaagatcgccgtcttccagcccgtctatataataggaatggacaaagtaaacgaatccttcttccgcttccgaaagcaaaggagacgtttggtgaaacgtcagccggttccagcccatatgcggcaccttcagcttgtttccttcggcatctctgtctttgagtctcacagcttttccggctaataaaccaagtccttttgcagagccgttttcggtgctctcttcgaaaatgagctgcatgccgaggcagatgccgaggagcagcttaccctcgtcaaccatacggtgtatgaattgatcaagcttcgtgctgcgtaaattgtccatggcgtcactgaatgatccgacacctggaagaataaaagcatccgctttttcaagctcttccggccggtctgatacgacatacgggacgccgatgcgttccagcgctttcgacacgctgaataaattgcccataccgtaatcaattacaccgatcatttacagcattcctttcgtagacggcacacccttgacgcgcggatcaatggatgacgcttcatcaagcgctctgccaagcgccttaaacacggcttctatcatatgatgggtattcgtgccgtaatgaacgatgacgtgcagattcattctcgcttcgagcgccagtttccataggaattcatgtaccagctcggtatcaaacgttccgactttcgcttgcggaaatgcagcgcgcatctcaaggtgcggccggttgctcaggtctacggcgacttgggcgagcgcttcgtccatcggcacaagcgctgatccgtaccgtttgatcccttttttatcaccgagcgcctccaaaaaagcctgccctaaacagatgccgatatcttcagtcgtatggtgatcatctatctccgtatcgccttttgcgtcaaccgttaaattgaattgcccgtgttttgtgaacaaatcaagcatatgagtcataaacggcacatccgtgctgatgtcggcttttccttctccgtctatttcgaaagccagcttaatatccgtctcatttgttgttctggcgcgttccgcttttctcatcggtcattcctccgtttctcgcttcaatcgatcttgcgtgcgcttcaagcccttccagtctcgcaaaggcggcaatgctgtccgcgtgtgtttcaaatgccttccggctgtaagagatgatgctcgatttcttttgaaagtctgttacattcagcgggcttgaaaaccgcgccgttccgtttgtcggcaaaacgtgattcggtccggcaaaataatcgccgaccggttcagcgctgtatcgtcctaagaaaatcgcccccgcgtgtctgatgcttccaagcaaagcctccggcgaatgcgtcatgatttctaaatgctcgggcgccagcgcattcaccgtgtccaccgcatcttccatcgattccgcgatataaatgcggccgtgatccctgatcgacgcttcggcgatttctttgcgcggcagggtctgaagctgtttattcacctcatctgataccgcttcggcaagcttctgtgaatcggtgacaagcacgcttgagctgagcatatcgtgttcggcctgtgaaagcaggtcagcggcgacttcttcgggcaccgccgtatcgtctgccaggaccacgatttcacttggcccggcgatcatgtcaatatccacaacgccgaagacttcgcgcttcgcgagcgctacaaatatatttccggggcccgtgatcttatcaacaggctgtatcgtttccgttccgtaagcgagcgcggcaaccgcctgcgcgcctcccgccttgtaaatttcctttatgccgagctcagaggccgccgccagaacgcctggcgaaaggcggccgtcttttcccggaggactgacgagaacgatccgttccactcccgcagcgagagcggggatgacattcattaaaacggaagacggataagcggccgtcccgcccggcacgtatacgcccgcggaatcgagcgccgttattttctgtccgagcatcgaaccgtctttgcgatggtaaaaccaagaggattgcagctggcgctcgtgatattctttaatattggcaatcgcctgcctgatcacttccagcagctgatcatcaagcagacggtatgcctcggtgatttcctctgcgctcacggccattcggttcaggctgatgccgtcaaatgtttttgtataggccaaaacggctttgtcaccgttttgtctgacgtcttcaataatccccctgacggttttccgctgctcttcggttccgctgtcgatggaacgcttcagtgaaaaccgctcgcttctttttactgcggttattttcattttgccgtttctccttccacaaccctggccagcctggccgccatttcgtcgattacatcatccttcatgcggtagctgaccggattgacgataaaacgcgatgtgatgtcacaaatatgttctgattcaacgagaccgttttcctttaatgtccgcccggttgatacgatatctacgattctgtcagcaagcccgattaaaggcgccaattcaatggaaccgttcagcttaatgatttccacctgttcgccctgctctctgaaataactcgacgcaacattcggatatttcgtcgcaatcctcggggcgactccgttccaatccgctccgggaagccccgcaacggcgagatggcatttgctgattttcagatcgagcacctcatacacgtcacgctcttcctcaagcatgacatccttcccggcaataccggcatcagcgacgccatgctcgacataagtcgtaacatccatcggctttgccagaataaagcggagattttcttcaggaacgtcaatgatcagttttctcgattcttcaaactcttcgggcagcctgtatccggcctgccgcagcaacccggccgcttcttcgaatatccgtccttttggcattgccattgtgagtaccttacccattccgctcttcctttctggcaccgataaagtatgtgacgtttgcgaatgattttgtcatatgatcgatattttcaatgcccgccagatcctgcaggacgacttttctgcctcgcgccctttcttcctccgcgaataaaatggcctgggcccgctgctccttgctgaaaatcacggcgtccgcttcacttgtttcttcctgaatgccgagcgcttcaatcagcctgtcgatacggagcccgaagcccgtggcgggagcgggattgccgaaatggccgaggagattgttatagcgtcctccgcttccgatgacgaaaccgacatttgccgcgtacacttcgaataaaattcccgtgtaataactcatatggcttaccatattcagatcaaggcgaatatgctcggcacacccgtaatcctcaagaatgtcccacaggtcttccagctcctgaattaagctttgtccggagattccgatgatctcctccgccttcgcgcaaatctctttcccgcctcgcaattccaaaagtgcgagcagccggcttttgtctattgaagaaagcggaagcgatttgacatgttccctgtatcccacgtaattcttttcaaagagaaagcgccgcagaacatccgcccgctcggcattgcccaaaacctcgacaaacagctcatcagcgagtccggcatggccgatcgcgattttaaaccggtacaatcccgcgtttttcaaagcgccggccgccagcgcaatcacctcggcgtccgcgcttgttgatccgtcgccgatcagctccgcgccgacctgttcgaattcggccggacgtccgccttcccgctcctgagcgcgatagacgcttgccgcgtaccccgctctgagcggatgattgtgtttgtgcagcttagatgccgccaccctggcaatcggtccggtcatgtcaggccgaagcacaagcgtttttccgtcctgatcgagaagcttaaacagctgctgttcttcaatggctgactggacgcctactgtttcataaaattcaagggtcggcgtctccataaactgataaccccatttatcaattaaatccgtcagtgtggaacggacttttttctttgcttcgtataaaccgggcagcgtatctctcatgccatgcggtttctcaaacataaacatttgccttttacacctccgctttgtctgaaggaaaattccgaatcctttagttcgctaatatgataatatgttagcagataaaagaatagattgcaacgcccaatgtccgcctattcttttccataaacatggctaaagaatgaacaaacctgtaaacatatcggaacaatcgaatcatattgagcagaagtgctataatacatagaacagcttcatcagaaacaagggagaataattgataatgaagacgcttggaacattatgtgtgctgattctgacagccatccttgtctatctgggatataacatctatacaaacgatattcatttaaattttttcaatcagcagtccgacgagcctgatgagaaaacaccgttaaaagggagcgcgtcaccgctgaatgtcgttctgtacaggcagatggattctcccagactgtacaatggctgtgaggtgaccagccttgccatgattttgaacaatgccggatatcatgtgtcaaaaaatacattggcggataaaatcaataaagttccgctcacatacagcagcgggctgaagggagatccgaatgaaggatttgccggagatatggaaaacggcccgggtttaggcgtttatcatgagccgattgataaacttgccaaagaatatgcgggaaacaaagtatacgatcttacgggaaaagacatttcttcagtgtaccgccagcttgaaaaagggcggccggtctgggtgattaccaccacatcctttaagccggttgatcatatgcagacttgggatacgccgaacggaaaggtcgacattacgttcagcatgcatagcgtagccgtaaccggttatgatcacgattatgtatacgttaatgatccttacggctataaaaacagaaaaacagaccggtctgactttgaaaaagcctggaagcagatgggcagccaggccattgtgatcaagtcataaaaaaaaccccgctgacgttaatctgcggggttttccattcgttttttcatttcttcgtccgtatagatcacctgcatcggatttcctccgacaaacgccccggcggggacatctttgtgcaccagcgtgccggctgatacaacggctccgctcccgatggtgacgccgggcagaatggttgtgtttgctccgatcatcacctcgtcaccgattgtgacaaaaccggtccggtactcatgtattaaatattcatgagccaaaatcgtcgtattatagccgataatgctgttttttccgacagtgattttttcgggaaacatgatatccggcatcaccatcagcgcgaatgacgtctgttttccgacattcattttcaaaaaggttcggtacagccagtttttcacgcttaaaaacggcgtataccttgcgatctgaatgatgatgaaatttttcatcaccttcagaaagggaaccgtctgataaacatgccacaatgaatttgcacctgaaaccggatggcggtctgtttttctcacgtgttacttcactccggtgatgtgcaataaatcactcattttctcgagcatataatcgggttcataggcggaaagcgcctgtgcgcctttaatcgtccacgcgacgccggctgttttcgtgccggcgttttttcccgccatgacatcgtgataattgtcaccgaccattatggcttccgacggatcgcacccaacccggctgagcgcaagccgcacaggctcggggtcaggcttcgggtgctttacatcatcaagcgtgacgacagtatcgaaaaacgccccgatgcctgtcagcttcaatcccatattgactgtatccctcagctttgtggtgacaataccgagctgatagcccgcttttttcaattcatcaagcgtttcataaaccgtttcgtactccgtgacgagctcatcgtgcttttcatggttgaatgctctgtacatgctgatcatgtcatcgcacttttcggcattaatgcctgaaaacgtttcgtacagaggcgggccgataaacgggagcacatcttcccttttgaactgccccgggcaataatgatcaagcgtatgaaggtaagaagcgataatcagttcattcgtgtcaatcagcgtgccgtcgagatcgaataaaatggcggttacacgtttatcagtcatcttatgtcctttccgatttcagtcgtcagtccgtgtcagcataccgcttatcagcataccccttcatgcgtctgaaaatcattaaaataatcgcaagtacaatcagcacaatggaaatgacctgcgcgatccgaagctggctcgtcagcatcaggctgtccgtccgcattccctcaataaagtatctgccgattgaataccagatcacatacgtcaaaaacagattgcctctgcgcaggttcacgcggcggagcagaagcagaatcacgacgcccgcaaaactccacagcgattcatacaaaaacgtcgggtgataatattgtccgtctatgtacatctgattgatgatgaaatccggaagatgcagactttccaaaaatgaccggctgaccgcttcaccgtgagcctcctggttgataaagttcccccagcgtccgatggcctggccgagcagaatactcggcgcggcaatatccgccagcttccagaatgagatgcctcttacttttgaaaagacgattcccgtcgcgatcgcgccgattaatccgccgtgaatcgcaatgccgcctttccaagttttaatgatttccccgggatgttccgagtaatagctccactcgaaaagcacataatatgcccgtgcgcaaatgattgcgatcgggatggcgaaaagaacaagatcaataaaaatgtcctttttcagcccccgcttttcactctccctcatggccatccaaagccctaataacgcgcccgcgccgataatgatgccgtaccagtgcacggataaaggcccgagctgcaaggcaatcggattgatcggtgttccagcttcattcatattattgccaactcctattcgtcttgttcgccgtcctcaatgacatccgccagcttattcgtgaattgttcggcagcattcaagcccatccgcttcaatctgaagttcatcgccgcaacttcgataataacggcgagattccgccccgggcggacgggaatggtcagttttgtaatttccgtatcaatgattttcattttttcttcttcaagtccgagacggtcgtattgctttccttgctcccaaagctcaaggtccatgacgatagtaattcttttattgcttctgacggcgcccgccccgaacagcgtcatgacatttataatgccgagccccctgatttcgagcagatgctcaatcagatcaggcgcgttcccgacaagggtatcctgatcctcctgccggatttcaacgcagtcatccgcgacaagacgatggcctcgtttgacaagctccagcgccgtttcacttttaccgacgccgctttttcccgtaatgagcacgccgacgccgtatatatccacaagcacaccgtgaatggccgttgtcggcgcgagacggctttcaagaaaattcgtcagcctgcttgacagcctggttgttttcagaggggatctgagcacaggcacgccgttttgctcggaagcttctacaagctccggcgggatcggcatatctctggaaagtatgatagccggcgtcacatcggtgcacagcgatttcatccgctgtttcttatcttcctcgggaagctgatcgaaaaatgacagctccgtttttcctaaaagctgcacccgttctctcgggtaatatgtaaaataaccggcgatttcaataccgggccgtgataaatcactcatcgtaatcgggcggttaatcccttcttctccgctgatcaattctaaatggaactgttccattacgtctttggtccgaacctttgccaagatatgttcctcctgttctgggatgttccgagctttgaacagttatattttatcactttaccgtctgaaccaaaacagatttatacaattccggcataactggtctagataactagtctgaaaaggagtaaaataaaactaacaactaaccagaaaggcgtgttttaaagtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggctcgtatgcgcttcccggaatgattgatatccatattcacggcggatacggcgcggatacgatggatgccgatgttgcggctcttgatacactgtccgcccggctgcccgaagaaggaacaaccgcttttttagcgacaacgatcacacagcagcacgaaaacattgaaaaagcgctcgtcaacgcccaaaaatgggcgtcttcctcaccgcagacccaaaaaggcgctgagttgatcggcattcatttagaaggaccgtttgtctctccgaaaaaggcgggagcacagccgaaacaatggattactcctgctgatgccgggctgtttcagaaatgggagcaactctcgggagggctgatcaaaatcgtgacgcttgcgccggaagaagatcctgatttcagcctgatccgttatttgaaaaaccaaaacatcatcccgtcaatgggacacacagacgcaggagccgagcttttacaaaaagcggctgatgccggggcggtgcatatgacgcacctctttaacgccatgagctcctttcatcaccgtgagccggggggcatcggcacggctctcgcctgcggccgcatcacggctgagctgatcactgacggcattcattctcatcctctggctgtaaagcttgcttatttggcgaaaggaagccaaaacctgatcatgattacagactccatgcgggcaaaagggcttaaggacggagaatacgaattcggcgggcaaaaagtcaccgttcgcggggacacggcgctcctctctgacggaacgctggccggttccattttaaaaatgaatgaaggcgcggcgctcatgcgcaggtttacaaactgctcatggctggatatagcaaatatgacatcggcaaatgcggcccgccgcctcggcatattcgaccgtaaaggaagcatcgcccaaggaaaagacgccgacgttgttctgacggacggacagtgcggcgtgctggccacaatttgccgcggaaacaccgcatatatctcaagggaggctgattggacatgaatgttatcacatgcagacattatgaagaattaagtgaaaaagccgcagcgattattgctgaaacagtgaaacaaaagccggatgccgttctcggccttgcgacggggggcactcctgaaggcgtatacaaagaacttgtgcggatgcaccgctcagaaggcttgtcattccggaatgtcacgacgatcaaccttgatgaatacgccgggctttctcccgaggacaaaaacagctatcattattatatgaatacacatttttttgcacacatcgacagccgaaaggaccgccactttctccctgacggacgggcagacgatcttgatgccgaatgcgggcgctatgaccgattgattcaaacactcggcggagcggatatacagcttttaggcatcggacacaacggccatatcggctttaatgaacccgggacgccatttgaatcccgaacccatgtcgttgagctgaatgaagagacaagacaggcgaatgcgcggtactttccgtcaattgatcaagtccctgaaaaagccctgacaatggggatcggaacgattttgtcaggcaaacggattttgatcatggcatccggaaaaagcaaggcccaagcggtgaagcagcttctggacgggcgcgtcagcgaagcattccccgcctccgccctgcacgcgcatccggatgtgacggtcttgattgatgaaaaggctgcgggcggcgattgaaaggatttgacctatgcagattgataaacaatctccgattccgatttactttcagattatggaacaattgaaaacacaaatcaaaaacggcgagctgaaagcggatgcgctgcttccgtcggagcgggaatacgccgaacaattcggcatcagccgcatgacggtgcgccaggcgctttccaatctggtgaatgaaggatttttatacagacagaaaggccggggaacgttcgtcagcaaactgaagatggaacagccgcttcaagggctgacaagcttcaccgaagatatgagaagccggggcatgaagccggggagcagacttgccgaataccagctgattcaggcgacggaagaattatcttctatcctggggtgcggctatctggcaacgcttcataaaatcatccgcgtccggctggcaaatgatatcccgatggcgattgaggcatcgtacatcccgtttgacaaggcgggaaaactggatgcctcccattttcaatcatccatgtatgagcatattgaagcgtacaatcagatgccgatctcacgggcaaaacaagagcttgaaccgggagccgcttccgaggaagaagctgagctgctcggtatccagcccggtgcccccgtcctctatatcaagcggaccacttatctgcaggacggcactgcttttgagcacgtcaaatccgcctacagaggcgaccgctacacattcgtgcattatatggacagggtgaaatgaaacatctccaaccgttacgggttggagatgtttttttgatctgccattttcaaaccaagccggtgaatgttctctatgactctgtcaaaacgaagaggctggggttccggtatctatttttataaagaaaagagtaataaaatgctaccctctgttttggataatatacggaacctgctttgaaatcagcagcagcggttctttgtttttatgagccaatgaaaacatgattgcgccttcaatcatcgagttgattgtcatcccaagcttctccgcttcctcttgttcaaacccatgctcaagaaatttagccgcaaacacatccgtccacttcttgaacacctcaacacaagtgcatcttaacgtttcattgatcagagcggtctcacccgccagcaatccaaccggcacgccctcaatattctgcggatcattaaactgttcagccgttacatgaataaagtgctgaatcgcttctacagggtccgcggattgagacatactattctgtatctgcttttcaacgcatcttcccgtatatttgatcgccgcaatggcgagttcttcttttccgtttggaaagtgatgatacacggaccctctgggtgctccgctctcttttataatttgattcaaaccagtcgcatggtatccctgaatctgaaaaagatatgcagaggtttgaataattctttctttagtcccggttttactgttcattatgtttcctcctgcatattacgaaaaccaatcgattttagtatagaaaagggacataaaaaagtcaaaaacacttagtaccgccattcatgttacagaaaaaaacctgctgaccgtcagattttcttctgaccgatcggcaggctttatgtttttgctatgggtttgaggcatgcctgaaatcaaactgatccggagccgggtgatacggcgtatttcccgttttgaacatccacagcggtgatattgttttgccgttgtacgggtccttcacgacggtgtaccagtaataaacggaatcaggctgcaggccgtcccagacccaatttgcggtttttccgctttttacgtgttttttatgaccgagcagttcgttcgtatagacgttgcattcaaaataatcggtcgctacccttttcctcttcggctgtaaatccatttctgctgagaattcgtctttatcagcgaacagatcggtgtcatagtaattgatgtcatccgtgtacggcgagtaggagaacatgtgaacctgattggcggcctgatcaaattgcataatgcgcataaagccctgccccccttccggaccgtcctggtagtcggtcagaatttggtggacgaggcggtccggttttccgtccccgtcatcgtcaagcgcatcggtttttttcatggcgttatggtaatggccgcttaataccatcgccacattgcgattcggcttgacgacttttcgatagatcgtctccccgatcgggcttcgatttccgctcacaagcaagtactcatgaaagcataagatggcggttcggtccggatacctcttcagcacttgattgatccagtcaatctcttgttccgtaatgccccagcccatataaatcataataaaatcgttcccgcttgccgacagcagatcataatgcccgcggttatttttgtatgatccgccgtaatgcatgttctgttcaaaccggcggctcccgaagaaatccccgaaggttcggtatgtgccgtctttatggccgacgtcgtgattgccggcaagcactccgtacggaattcccgccttgtcaagcgtccgcatggagtggtcggcgtttttccactgtttcatcaccattgaatcatcgacaatatcaccggtatgaaagacatatttaatattgtgcttttccttattttctttgatccactccgtcattttgtcaaaaatgtgcgggtgcccttgtgcgtaatactgtgtatccgacatccagacaaacgtgtaattgcctttcgccggtatttgatcctgcacgatgacattcatttttgagttcttcaccacatccgctgcggaaacggcggcttttaatgtaaacggctttttatctttggcaaggacgctgtccgcctcctgccagcggcttgtccggtaattccaaaaatacatggttacctttcggccgggcagagagcttcctttccagacagcctcggccagatccgtttcgtcgatagacgggtcaacggagacttcgaaccggtgataaggaaaacgctccatactttctgccgaaacggtttttccgtcatttgccgagatacggttcatttccggcagggtaaacggcatttcattttcttttatgcccctcggcggttccgttaatgaggcgtgtttatacactttcacactgcccggattccgcgcggtataacggaagccgcgataaaatgatacattcatgtcatccttcgtcgggtcttttacccggacggacagctttgctttgcgggcgccgattttttgaccggcaagctccggctggttcggctcctcccgtttgatatggaaggtgcggacggacgttgtttcatttccggcaaggtctgccgcaatgatggtaagggtatgctttccgggcttgagatcggctgatgacgtgtgatgcgggagcgtaatgctttctccgtccaaaaacgctttcacctcttccactttgctccatttgtcacggatgtccgcattcagctcaacattacctttcagcgccgcgccttctttgatacctgggacaatcttcggccccgaattgtccacccgcacagattggctcagctgctcctcaccgtcgctaacaaaaatatggtgatagccttccgaaagcttcgccgtgttccacggcagcagccgtgacgtaaacaaatgatccggcaggctgaatgagaaggtcttctgctgattcgcccgcctgccgtcaccgataaacagctgctcggacggatcggtcttcccgtctttgatcaccgttccgtccgaaagcaccagacgggcatgtttcacgacaaaatcatcccgattctctcccgtgtcatacggagaaacctttgagcccgaacggatggatactttctgtgttttgccgcctttttgcagcagacgttccggaagcagaaccgagtgcgttctgtagcggtgagacggatcgtcaaaaatgtgcagcacctcgttttccatcatgacggtgttttgaaaataaagattcgttttccgggcatcgaaggcgaaatagacctctttttccagcgccggacgggtctcctgccgcttgccgtcaatccacagcttgatcttatcggcgctgacgtcggaagtcgctttgagcagataggtgccggatatcgtatcttctggttcaacattcattctgagtccgtgtgatttgctcgtctgttcaatgtcaatcatcttgacgggcgtttttgcttcattttctccatcactggctgcgatataatactcaagctgatcctggccgagcagttccggggaataaagaatgtgatggtataagctgtcgttgcggtctttttcggccagaattcgtttgaatggttttttctcattggtccggtaataaaacgcggctgttttgacaaggtttttgtcttttatgtcagcctttaattcaatgctttcagcgggccggacgggctttctgtctgtaaggtcttcgatgaccggtttttccttgtccggtttgatcacccttttctgctgcggaatctgcgcctgaaaaacggagcccggtgacggcttatgctcgctcgtggagatcttcagcaattctcccgttccgttcagcggatatttgtacagcaaagaagtcagtcggcggaaagcgtgtttccggtattgcgctgaggcgatatccttgccggtatttgccgacagcacgaccgtacgcgggcggccgttggacattccgtccgtcccttcgatgacggcgagatgttctccttccttcagatgtgtcccgtaatagcggttgaaatcatctatcgtcagttctgatgcggcgcgtctcagccaaaacacgtaagtcccgcctgacggaatgacggtatcttctttcggcctccatatcatatctgattccggcccttccttcggatagcggtagcggatatgatagtctttaaaatgaatgggcctgtccgtcgtgttatacacctcgataaattcataggcatcagcgccgtcttcatttttcgtatcaaccgcaagctccgtaatcatcagctcgggaatatgattcaaatcggcttgatagccgtccagcttcagccgctttttctccgattccgcccgctgtctgccgttggtgaaaacgaggtaatattccaattctccattccagatatcccgttttgaaacctgggccgtaaaaagccggattgcgcctggcgcgggctccatcggcaccatcttaaaccccagctcattgctttgtttataaaaaagaaacgccgaaaacgcttgatagtcagcattccgtacatgagcctgtatgaacaggtttcttttcatttccgcctttacttcgatttggggaggattctccagaagcggtatgtaatgaggcggctgtccgaattcctgctgattcacggggattgccgattctttgcgcgccgcatccgcagaaggactcacacaaagcaaaccaatcagaaaaaagagcgtcatcacaagtttcatctcattacctccctatgcattatgttgcgtcaggaggctgccgcttatgtaaaccgcacataaaaaagctgccctctcgggacagcttgttttttatccttttctaagcggctccaatatgcctttttggatcagcaagtggaaaacggacagcacgacggatgcccaaatggcggtgccgaacccgtcaatctgaaagctgtctcccatcaaggctgcggtcatcattaacgtaatggcgttgatgacaaacagaaagaggccgagggtcacaaccgtgacaggcaatgtcaatatgacgatgatcggtttgatcagcacatttaacacagaaagaatcacactggcgatgacagccgctccgatactgctgatatggacggaatcaaaatatcccgcgataacgattaataataaagcatttactaaaatgctgactgcccatttgatcatttatttcaaatctccttctaaaggtacaacaaaacaccagataatatatacaatcggcacgattccgctcgtgacaagcgctaatacaacggttataatgcgcaaaagcgacgcatccatattgatgtactccgccaaaccgccgacgacaccggcgattttacggtttttttctgaacggtaaagtcttttcatccaatcacctctgagtatgcttgagcttaatggctcctgttaacgattctgagaaaatcgagagatgctgatcatggccttgatttgatgccagcatcagttctttttgaatggtatcattcttttcctttaaaatttccgcatcaatcagctcatggctgagagagccgagattgcttttgagctccgctttcaccgccgaatcatcaggcagagcgatctccacgtttccggtcgtcgttttcgtgtagatggagcggcagtgcggcgctgtcacggtaagcatgatattgccgttaaagctttgaacgtcaatggattcactcgatccgcgcaaatcaatcaagccgttgatcgtttccgcttcaatcgcgccgcattgatgtccggccagcttgatttgtccgttagccgtttccgccgacgctttctcagccgtcaaatgagagaatgacagaacgccgtttgtcgttttcgccgagaattcttttacatgtaaatgttcccctctgatcggtccgttaaacagcttcactcttatcttatcgtactctttctggggaacataaagcgtaacattggttttcatcgttttcttttccgtgcggacaaaaaacttattgcccttcacttcacactcaatgtgctgtagaaatgcggtgcgcgccgcctcctgactgtccgcccggtacactttcgcctggcactccgctctgatatcttcatccgcccacggtacgatattgacgctgccgtttgcgatctgcatatcaatggccgagaattcactgtctttaaattgaaaaatatgctgcacttcgtgtgcgtggccgaaattcagatcaagatccgcttccttcacttttttgacggcagaatcaatccagtcgaacagcttcgccccgagcgacggcttttggctttcttttgccccgctttcgaaatcttccgcaggttcctgaacctccgcagataatgcggtgatctgctcttctttttctttatattcatgatccagtttttcaatgagcgtcagtgcttcctgcgccgtcagcatcccgtcttccacaagctttaaaatccgttctttctcctgtttcatacaaaactcctcccccgacttttcttacacctggcgtaacaccttaattccctgcacgatattccaaatgaccattccgatgaggatcagaaaataaacagctgctcctgttatcataacaaaaacgggcaccatactctccccctgggccgtaatcaatccgccgacaacacccgcggtcacaatcagcaagcccgcaaacggaatgatatgggaaatcagagcgcgcatggcatgccgcttcgtctctttttcatcgacgacaaaataagccacaatcggaagaatgagcggcgcgagaaacacgctgaaataacagattgatgcgataattgcttgatttcggttcaataaaaacactccctgtgccgtgatgtaaaaaacccttccttatacatacgtatgacgaatgagcgggtttcattttcatgctaaggacatgcttcgttatacgtaatttttggtttcagagatttcactatagaatcttttccccgaaccgattacaatatgtaacaaagcctgaccgtatgcaaggaggacatacaaatggagaaagatcccgaaaacgcccaagtaacggaagagagtcttcgaaatttaattcgcgaacagaaaagaatgaacagcgaaatgctggctgaattggaacagatcaaagcagcccctcttcccatttcccatgatatccaatatataaaagtgctgctggacagcagcagcacccatattctgcaggacttaatgcatttaagcagacagcttccccaacagaaaaaaagcctgtaacaacaacagcccaaaaccgataagttttgggctgtttttattgatctattacgtggctgccgtttctttttcggccagcaatgttttcatccgttttttatcgcgttccattaccggtttcagatagcgccccgtatatgattctttcacttcgacaacttcttcaggcgttccggaggctacgatcgtgccgccgcccgctccgccttcaggtcccagatcgacgatgtagtccgccgttttaatgatatcgagattgtgttcaatgaccaaaacggtatcaccgttatcgacgagtctttgaagcacaaccaaaagccttgcgatatcatcaacgtggaggcctgtcgtcggttcgtccagaatatacagcgtccggccggtggaacgcttatgcagctcggaagcgagcttgacgcgctgcgcttctccgcctgacagcgtcgtcgccggctggccgagcgtcacatacccaagtccgacatcagcaagcgtttgaagcttgcgtttgattttcgggatattttcaaagaaagacagagcatcttccaccgtcatatccagaacgtcggaaatgctttttcctttgtatgtgacctcaagcgtctcccggttgtaacgtttgccgtggcacacttcacacggaacgtacacgtcaggaaggaagtgcatctcaattttgatgatgccgtcgccgcggcaggcctcacagcgcccgccttttacattaaaactgaaccggccttttttatagccgcgcacctttgcttcatttgtctgcgcgaatacatcgcggatatcatcaaacacacccgtgtaagttgccggatttgatctcggtgtccggccgatcggcgcctggtcgatgtcgatcaccttatcaaggtggtcaaggcctttgatctctttatggcttcccggtttcgctttggctttatgaagcttttgcgcaagcgccttatgcagaatttcatttacaagcgtgctttttccggaaccggacacacctgtcaccgccgtaaaagtgccgagcgggaatttggcgttcgcttttttcaggttgttttctgaagcacctttgatttcaatgaaccggccgtcaggctttcttctctccggaggcatcgggatgaattgagcccctgacaaataacgtccggtcagagaatctgcatcattcatcacttcttcaggcgtccccgccgatatgacgcggccgccatgaatgccggcgcccggaccgatatctatcaaataatcggcagccatcatcgtatcttcatcatgctccacgacaatcagtgtgttgccgagatccctcatgtttttcagcgcgctgatcagacgatcattgtcacgctggtgaaggccgatggacggctcatcaagaatgtacaggacgcctgacaaacgggagccgatctgcgtcgcaagcctgatacgctgggcttctccgcctgacagcgttcccgccgccctgctcagcgtcaggtaatcaagaccgactttatctaaaaagctgagacgctccacaatctctcttaaaattaaatcggcaatctgcatatctttctcagacagcgtcaggtttttgaaaaattccagcgcatcgccgacggaaagctcggtaatggtgccgatgtggcgcccgttgaccaaaacggcaagcgcttctttcttcagccggtagcctttgcatgtcgggcacggcttctgtgacatgtactgctccatctgttcacggatataatcggagcttgtctctttataccgtctctcaatattgcgcagcacaccttcaaattcaatttcattttcgcgcacttgtccgaaatcattctcgtatttaaagtagatccgttcattgccgctgccgtacagcactttatcaagctgatgcttcggcaggtctttgaccggagtctccatatcaatgccgtaatggcggcagaccgcctgaagcagctgcggataatattgtgaactgatcggcgtccacggcgcgatggcgtgttcctttaatgacagttcaggattgggaatgacaagctcagggtccacttccagcttcaaacctagaccgtcacaagtcgggcaggcgccgaacgggctgttaaacgaaaacagccggggttcaagctccccgatagaaaaaccgcacatcggacaggcgtgatgctcgctgaacatcagctcttcctgaccgatgacatctatcatgacacggccttcccctaagcggagcgcggtttccagtgagtcggaaagccgtgcggcaaccccttccttgacgacaatccggtcaatgactacttcaatggaatgctttttgtttttttcaagttcaatatcgtcggaaagctcggccatttctccgtcaatccgcacccttacgtaaccttgctttctgatttggtcaagcactttgacatgggcgccttttctgcctgagatgatcggcgcaagcacttgaagcttcgtccgctccggatattcaagaatccggtcaaccatctgttcgatcgtttgcgacgtaatttcaatgccgtgctccgggcagtgcggcttcccgaccctcgcgtacagcagccggagataatcataaatctccgttaccgttccgacggttgaccgcggattgcggctcgtcgttttctgatcaatgctgatcgccggagaaagcccttcgatcgcatcaacgtccggcttatccatctgccctaaaaattggcgcgcataggcagaaagcgattcaacataccgcctctgtccttccgcgtaaatggtgtcaaaggcaagggatgattttcccgatccggacaggcccgtcacgacgacgagctgatcccggggaatcgttacatcaatgttttttaaattgtgcgcccttgcacctttcacctcgatccggtcaattgccatgtgttcatcatccttccgctttaagctctaacagtaaatcacgaagctctgccgcccgctcgaaatcaagcgctctggccgcttctttcatttcgtgctccatttgctcaacgactttctggcgttctttcttcgtcatcttcgccagtttaggcgcggcttttgttttatattcttctttatcctcagcggcctgcgtcgcgcggatcacatcgcggatttccttattgatcgtttgcggcgtaatgccgtgaatttcgttaaagcgctcctgctgttcccgtcggcgcttcgtttcattaattgcgatctccatcgaattcgtgattttatcggcatacatgatgacgcggccttccgcgtttcgtgccgcccgtccgatcgtctgaatcagcgaacgttcagaacggaggaagccttctttatccgcatcgagaatggcgacaagtgacacttccggaatatcaagcccttccctcagcaggttgatgccgattaacacatcatgttttccgaggcggaggtcacggatgatttcaatccgttcaagcgtcttaatctcggaatgcagataattgaccttgatgccgatttccttgaggtaatcggtcagatcctctgacatttttttcgttaaagtcgtcacgagaacgcgttcattccgttcaatcctcgcctgaatctcgccgatcagatcatcaatctgtccttcgatcggccggacgtcaatgaggggatcgaggagtcccgtcggtctgatgatctgctcgatcatttccggcgtatgctcaatttcatacggtcccggagtcgccgacacgtacacgatgttgtgcatatgcttttcaaattcctcgaatcggagcggacggttgtcaagcgctgacggcaggcggaacccgtgatcgacaagcacctgttttctcgcctggtcaccgttgaacatgccgcgcacctgcggaatcgtcacatgtgattcatcgacgacaatcataaaatcgtccggaaaataatcaagcagcgtatacggcgtagagccaggaggacggagcgtcaaatgtcttgaatagttctcgatccctgagcaaaaacccatttcccgcatcatttcaagatcatacctcgtccgctgctcaagccgctgcgcttcaaggagcttgccgttttcgcgcatcactttcaagcgctcctcaagctcctgttcaatattcagaatcgctttttccatcttttccgcccgggtgacgaagtgggaagccgggaaaatcgcgacatggtcacggtcgccgagaatttctccggtcaaagcgtcgacctctctgatccgctcaatttcgtctccgaaaaattccactctgatacaatgttcgtcacgggaagccgggaagatttccacaacgtctccgcgcacgcggaacgtcccgcgctgaaagtcgatatcattgcgggcatactggatatccacaagctttctcagcagctcgttccgctcaatctccatttccggtctgagcgacacgaccatttcccggtattcttcaggcgaaccgagaccgtatatgcatgacacactcgcgataataatgacatctctccgttcaaacagagaggatgtcgcggagtgtctcagtttatcaatttcatcattaatgcttgcgtctttctctataaaagtatccgtttgaggcacgtacgcctccggctgatagtaatcgtaatagctgacaaaatattcgatagcgttgttcgggaaaaactccttaaactcgctgtacagctgtccggcaagggttttgttatgggcaatgaccagtgtcggtttattcacttctttaatcagattggacacggtaaaggttttgcccgtccctgtcgcacccaggagagtctggtgttttctgccttcctgtatgcctttgacaagcttctcaatcgcttgcggctgatctccctggggctgatatttcgagactaactcaaaacgatctttcacaaaaaagcctccgtttctttacgaaatcttcctattgatatagtaacacaatgacgggcaaaatcactaaaaatacgaactaaagttcgatggtttatttttaccaagtcaatttttgtataaaaaacctgcttttatggcgtaaaagcaggcattctatttcatattcaccatgtcaggcattgtctttctttttgtctgcttcttttttggccatgtacagccctccggccaccagcgatacgacatccaatccaacgataaaatacgtttcggtgtaaccctttaaataggatgcgaaaagcagtgcggctgtgagagcgatcgccacatagtggttaaacgtgacgcgcgtaaaaaggacgaccagcataaaagggaaacataatgcaaaaacggcttttgtaatcacaaaaaccctcctcgggaattcttcatctcatctgattatagtaaaaaatgaagaatcggacaatcgttcccctgctatcacaataccctttttcagcagtcttcaatcatctgtcaaaaaaaatgtgaatataaatccattgaaccattaaccagatgaatcgaactacctttcttcagccgaaaggatgagaaggtttaggtctttgtatctttgacagtttcttcctccctctttacaatgtaatgatagtgtttactatcattttcttggatgaagaaaaaagggggtcataccgcatgtattcagtgcgatttcaaaaagcggaagaatcgagccgctctgcaggagcaaaaggaatgaacctgattaaactgacgaaaaacgggctgcccgttcccggcggttttatcattcagacgaatgccctgatacgttttatggaagacaacgggcttcaagcagatcaggaacagctggagcgcgccattatgaacggcacgttttcaaaagagcttcgggaggaactgaccgcgtcgttttatgaattgagagaatcatacgcctctgtcgccgtacgttcctcctccgcgtccgaagatcttgaaggcgcttctttcgcgggccagtacgaaacctatttaaatatcaaaacagaagaagagtttctcggaaaagtgaaagaatgctgggcttccttcttctcggcgcgggtcagcggttataaagagaaaatgaacaatgacaccgcagaaccgttaatgggcgttgtcgtgcaaggtctcatcaattccgaggtttcaggagtcattttcagccgcaaccccgtcacacatgatgacggagaactgatgatcagcgcgagctacggtctcggagaagcaatcgtctccggcagcgtgacgcccgacacatttatcgtcaataaagacacatttcagattgaaaaagaaatcggcttaaaagaaatgtatatcgtctctaaagacgaaggcgtgacggaaaaagagacgtccgctgacatgagaaaccgcttctgccttgatgacgagagcgtcaaagagcttgccatgctgacaataaagacggaggaactgtacggttatcccgtggatctcgaattcggatttgccgaaaataagctgtatctgcttcaggccagaccgattacaacgatcgcgcaggatcagaaagcggcagacgaagaacgggaatttattatgacgccccgggatcagaaagatttttggctcaatatggaggccaatatagaaggtcccgtcagcccgttattcgcttcactcattgtgccggctttggaatacggcctcaaagagagcacgaaggccttccctgtgatgggcatcgagattgagcgtgtcaaacttcatcagggccatgttttttccagacagcataagacggacgacaagctgcccgcagaacagttagaagcgcttttccccgtcttggctgaccgcatgtacgatattattcaggaaacctttctgcctttttatcaaaagctggacgaactggcgcatacagaccatacaccggagactgcccttgatgcgttccgaaacctgcaagacttctatttaaaaggatacgaagaacatttcaatattgtctttccgcaggttgcgttaaacatgatactggaatctatgtacggacaggttgagaaagaaaacacctcccttctgtatgaaatgctggccggcgtcatgaataagtcattggagaccgacagacagctctggctgctttccggacaagtaaaagacagccctgaactgcggcgcgtctttacggtttctcatgccgatgagctgcatcagacgcttctgcaatcaaatgagggaaaacgctttctcgaacaagtcggcgaatttttacaggaatacggctggagatccgtgaaaagtcatgatctcattgaacaaacttgggcggaaaacccttatttcgctttggccaacattcagaactatgtccggaacggatacgattttgacagtgagtttcataaaacgatagaaaaacgaaaacagctctacgccgactttatggatagaattgaagatgatggcttccgggagacgtttgaccgctattatcagtggacattgtcttcatccgtcatcaaagatgatcaccatttttatattgatgcgatgctggacgccaaagcacgcctttgccttctgaaaatcggcgagctgcttcaaaaacaaggcgtaatcgatgatcgggaggatatgtggtacttatacagcgatgaagtcgagaaagcgctggcgtcgccggttccgatgcaggaaaaagccgctgaacgaaaacagctcttccagcaatatcaattgcttgaagcccccgcttatctcgggactccgacttcggaacagctgaaaacggctgaacagattaccggctccatcacagaagatgaaaaaaacactgaacatcaaatttacggacttgcagcgtcaagcggaattgcaagcggcccggtgaaagtcattcgtgacgcaagtgaattttcccgtttttcaacaggagacgtgcttgtctgcaaaatgacgacaccgctttggaccagtctgttccaggatgcaaaggccgtcattacggacacgggcggcatcctgtcacatgcggcgatcatcgcgagagaatacgggctcccggccgttctcggcacacgtgccgcgactgacaggctcaacgacggagatatcgtcacggtagacgggacaaacggcaagattacgattgtcaaacgcgcttcatgctaggtttccctctttattgacgggcagggcgggtgtatacttgtcctgccagtatttacgcgaggtgaaacatgttgagaacgacgaacaagagaattattgacgccgcgatgaatctgatcatccaaaaaggataccgcgcagcgacaacaaaggaaatcgcagaaaaagcaaaagtaagcgaagcaacgattttccgtaattttaaaaacaagcaaggattaatgaaagccatgattgaacagcaggcgccggttccggaaagcatgatcaccaaggcggaaggcgatctgtatgaggatcttcttcatttcgccgcgacccttctgcagcaattggaacaaaaaaaagaagtgttccgcatctgcctgcgcgaaccggaactattcgaagacgtcctgcaggatattgtcgtatatcctcaatccgtgaaaaagcatttaatcgtttactttaaggagctgacaaagaaaaatataataagccccggcagcgaagaagctaatgcagacgtctttatgacgatgattttcggttattttatacaccggctgcagctggggaaaagagtcattactctctctgaggaaacgatgctgaaacacagcactgagattttcatgaaaggcattaccggccggtcattttccggctccaaggaggatgaaggatgggttcaaagaaagaatgggcgctgatcgtttcgcttttgctgggagccatactcgttcccatcaattctacgatgatcgcagtcgccctttcgtccatttcccgctcattcagcgaatcaattgccagcatcacatgggtagtgaccgtgtatttaatcgtgatggccgtgacacagcccatcgccggcaaactcggtgatatgtacggtaacaaaaaaatgtatttatggggcgtcggcctttttctcatcgcatcattggggtgcgccctctcaccaagtcttttcttattgattttcttccgggcgcttcaggctgccggcggcgctttgcttacgccaaacagcatcgccatcatccgccatgtcgtgtctgaaaaacgccttccgaaagtattcggttttttcggcctcggcgccgggctgggcgcggctctcggtccgtttatcggctctctattaattgagagcttcagctggcattcgatcttttgggtcaacattccgtttcttgcgatcgcactcgtgacggcattaatgatgtttcctaaatataaagaagaaacgtccgacgcaccgcttgatatcatcgggtccgttttgcttgccggaagcattgtgtctattattcttctgacgaaaaatgaaagctctttgggctattgggtgtacgcgctgctcattctcatatttgttccgctatttttcaggcgggagctgcgcacgaaacatccgattattgattttgacctgtttaaaaacacgacctttacgagcgccaatctgtcggtcctgttaagcaatttaatgatgtacgccgtgttattgattatgccgctctttatgaccggccacttcagcatgaatacgtcgcacagcggcatggcgctgtcagtcttttctgttttcatgtccgccagcaactggggcggagctcagctgcaccagaaatggggcgcgcgaagaatgatttttctgtccttcgggctgatggctgtagccaatctcttatttctgcttttggtttattcccattccgttccgtttcttatggcatcgcttattgtagggggcatcgcgtccggtgcggggctgacgagcatgcaggtgtcttctcttgcgacggtagaaccgggcatgtccggtatcgcatccgggattttttccaccttccgttatttcggaagcattatttcttcagcactgatcggtttaatctccgggtttcatattctgtttatcatattgatcggagtttctgtgatcggcttgttcgtatcacttggaattaagtccggcgaaaccgttgatacgaaaaaaagccattcggcgtaaacaaaaaaaggttccgtgagcacccgctttccggaaccttttctagttttccttcttatttttctctctcgaaagtgtcaccgcactcccccgctgcatagagtatcgcaatgcggttttgctctatgagaatctttttatttaaaagagaaaagggaaatgtaaatcgctaagagctcagatcaagttcggccgcttgcgccgtaatccggccgtaaaaaaagcccggccgccgtgttgttagcggcaccaggctttttatatgtgatttttcataattaataaaactgaaagcttattatttccaatgttttttcttaatttttttcataattctccttactaaaacctacctaaaacaattattgaatattacttttataattaagcaaaattaagtaacaatcattgaaggattctcagactgataaaatttattttaaatataatatttcaaaacacattcaaactgtacaaagaaaagaaagtctaaatttttatttttggaacttgattgggacaagaaagtctaaaccaaaatctttttagatttatataataacacgtctgtcgattatctaaattctaccaaaaaatgaatgcaaaagagagattcctcttgtacaatgtaagttaccacaccaacattgacgaaacgaggaatctctcatgaacaagaataagtctctgtatctttaacaatagtatttacaatatcattaggataccgattcaaaaaaaaatgttctcctttaaacttatgaaatttcacgtttccttcaacaacttcactccatttatgcatttcattgatatgagtcgaaaaatcgctatccgcataaaaaacgcttactccacaacttattttttctgctttgggctgaaacttataattgtccaaaattataaaatctgctcgcaaaatcggaagaaacatatccataatctcttttgtataaaactcctctggtattcccccatattgttccacctttgtcaagaaagtttcattagtcatattttcaatgtcttctctcttttcaaaaatatgtggagcatctcgcccagaaaaaaacagatgccttggttccttagttcccatttgcttaagtttataatatatctcataagtcaataaggctcccatgctgtgtccaaatataacatattcatcgtcatattctaattgttcacttattcttttggcgatatcttcacttgcttcatcaacagactggtaacaaggctctgtgaatcgagttcctcttccagccaattcacatatacacaattcatatctatccggcagtagttttttccattcataatatgcatttaccgacgctccagcatatggaataggaaatacttttattttatttatttcactcactcctatgttcaacttgagcccactatcattactatataaacctataagtattcaagatacatttaattgtacttctctatctctcgctgctctgccagcaacaaattcaccatatcactatagctattcaaaccgtctgtctgattatttgccttcagatatacatcatttacatttcttgaaatacttgaaataacaccctcatacttatcccggtactgctcattttgttctatatcatgctgcaccgccttggacagactggacattatatcagacgcctgatctggatccactttctttagctcagatatagaataatcaaatgctagaaaaaaaccactgtaaagtatcattggatcatcctgctgcttacatgccagatatgctataaaatttgcctcatcctcatgcatgaaaccactctgatgtgccaattcatgtgccatagtagcaggcaccaaaaaaactggcacattaacattgatattggattcataagtaaaagggacaaaaataccatgtatccctgcatgcgacattagttttgacatcaccactggttttggtgttgaatatgaatgctccaaaacaggatatttctttgataacatttgcattgagaacactgcgtgttgtgcataataatcaaaaacctctggtacatgagccaaaagatcagtatccgctaacttttcccttgccaattccatttcaacggcaagcgacttactcaatttgaccagttcctccttgctgtagttctcttctttatattcggtataagacaaaaaagaatatctgtaatagtttattccacccaaaatagtataacaaaaatatatcacgctacagatcgtaacgattcctagagcaccacgataaactaccatcctacgtgcacctttactcatgatgaccttgcgcacataataaacgatataaaatagaaatagtaacacaaccaacacgacgagccattcactaacagaaaatgtgacccaagaaggtacaagtcctactgtttttgacaataacggatatacagacctactgtatttctccgcccaatcctgatggttctgcgcgtattttgtcagtatataagctataactccaagtgagatcaacggcaatctcttaagtaaaagcttttttataatgtactccccctatccaacataaccattataatcagttattcttaatatatatcctgctaaagattcatcttctaaaggttttggagttagcaataacctttccaaaagccatacctctccttcatttatttttttattattttcaaaataaaacagctaagaaaatataattttcttagctgttttattttgaaatctagtttaggagttcttgaaactattccgaataattatgaaaaatcacattataatgctgtcatttcttcgtgctcgtgttcatcctgcacgaataaaatacctaattcatgatgttcgccttcataggacgcgcgctgatcaaaccggatttcaccattcaggccgatgatctccatttttacaaatgcgcggtttttttggagtgcttcataaaaatccgatacatgcttcacggggatgccgtttactttcgtaataatctcaccgatcttcagctcaagatcgtccgcgggtgtattcggaatgatgccgagcaccattaagccctgatcccgcttagagaaataaaacggagccgcgttatcgttcagccgctgtctcaatgataaaaacaggcgtccgagcaccgcaatacaagcggcagctccggcaagcggagtccaccaaagggcagctgccccgaatgcggtcacgataaccccgagaatcatgacacgtttcgccgttatccttatgctgacttccggaagtgacccctgcacacgctgtccgaagccggcgatataaggaatccagatcaaatggaaagagccgcccggcacggtaaagacaggccaccaagaaagatgtgactcaagcccgctgcccggcaccaataagaaaagcggaagcagccatgcgcgattcgccaattgtcggccgatgggcaggcctctgctgctgacgacaagcgccggagatgttttcagatgcgctgaacggcaggcagccgctccctccgtgataatcaaaaggcccataaacacggccgccgatgcccaattcacgccgaatgcctgcggaaaccgatccgcaaacggcactgtgtgggtatactgaaggagaaacgcaatgaacatgccggcgctgacaatataagctgatgacagccaattcatacggaacgtcagcgaagccaaagccgtcacggccgcgattatgccgagaagaccgaatggaatcgaaattcccagtccaaaaaataatatggagagaagaatacccggtataagtccttttatgtatgtaaagataagctcgtcatacatatccgcgatttttgtatgaaacgtatggcgttcacgtttgatccgcaaatatccgcatgcgagacttatgatgataaaaaaccagaacatcgggtgcaaaaaaaacagaccgatacttttcagaagttcaattccccattgaacagacactgctttcaccgcctcaagccaaacattttaattctattctaccaaataatcattggcttgaatatctcaaacgtctatctctcttccgtcatccacagcgttacatttgagagagagaaatctttcagatagtggtcaacctccacctcgatcacgccgctgatcagaagcatggaccgcttaatatccgtcagattgattcctaaacgtttatggtttttcattaagtaagtgaaataatgcttcgcacactcttcattgatttcgtgaacgcattcaacatttgtgtaattgaccaggtatctgctgaacagcataagaagacttagtgcttttgttgatgaaaatgtaacgtcttttgttctgtcttttagttgttccactaattcataatattttttttcacgcacaatacttgccctcttcaattgtgaacccccatttttttatccagataagcacgggtgattacagctgccgtgctgaagcgccgcaaacacttctgctttcgatactgaaatgcagctgccaaactaaaactgttctctattagaaccttcttttattgtaagaactaaaactgactgaggcaactttcaaaagtttcattttgaatacatattaactcggcataaagtctctcttctctataaatatcgggtaatgtttgtcctttataaatgtttaaatgtgaaaatttttttaatatcttgtcaaaaccgtcataattatatgtcttttggttcattttttacgaatgacaaaagaaataggagacgcaaaaaacgcctccttttcatttattttacaaataatgattttaacgccatttgcagctgcaaatcatttttttcgtcagatttcttctcattcatcagctgattcattttttccgctgtctttttatcaatgactgctgttttatcaagcttgtaccggtcttgaaacgccagaacggcttttttcattgttttgctgaaatagccgtccgctctgcccgggtcgaagcctaggcctttcagcaggatttgggcgtgtttgacatccgcgctgttcatatcaggctgaagcggctgtttcagctgaagcggtcccgccgcaaaataatccggctggctcacggcgattgtcggagcaatgccttttttgtgaatccaattgcctttcggtgtcagccatttgtaaagcgtcaatttaatgttgctcccgtctcccataggcacggcctgctgaaccgttcctttaccgaaagaagtgtcaccgacaacgtcataatgtcccgcttcttttaacgcgcccgcaagaatttctgaagcggaggcgcttcctttatctgttataatattgacgggatacggcttcttatgttttaaggttgagaaatattgttttttatcgccgttacgctccgcaatttggatatacggcatgtcttttgtgatgaaatgctttaaaatttgttcgacgctttgaaggtagccgccgggattcccccttacatcaaggacgagaccgtcaatcccttgtttttcaagctttttcagcgccgcggcgaagtcctcggcggtatgctcggaaaatgtcgatatgccgatgtagccgacatgatgaccgcctgattctttgcgggaagcaaatacggtttcaagcgggatttccgctcttttaatccggaatgacagctgtttttcagtacccggacgctgtattttaatagaaaccttcgatcctttttttcctctgattttcagcacggcttcgtttaaatctttcccgttcattgacacgccgtttatactgatgatttcatcattcggcttgaggcccgctttttccgccggagattgcttaaacggtgatacgataatgattttattgtctttcataccgacttcagcgccgatcccttcgaaagaagaatcaagagaatcggaaaactgcttagcggtctgcttgtccatataaacggaataagggtcgtttaatgtagacagcatcccctgaatcgctccttcaagaagcttttctttatctacattttccacgtattcgttcgagatcagctcatatgctttttcgattttttccattgcccggcttctttctgcgtctgatgaattcggctgtgccgccccggcaatatgggctccgccgcacatcatgcttagggccgctatcactgcgatcattttctgcttcatcgtttacctcctcttagtccttttacgaaaacctggagatagtatgtgtaaattgcaaagaattcatgtaacggcaacaaaaaaatgaaaatgcgagattgtttcatatatatgggtaacgtataatattttgtatgcaattcattatatatacaggagaatgcgatatgaaaataaaattatcgattttatccgcggcggttctggccgcaggcattaccgcctttgtctggccaaaaacagaggccaatgagaaaacgcagacggacgccctgtatgtttctcccgcaggcagcgaccaaaatgaaggaacgaaagaaaagccgttccgcacattaaaacatgcggctgaaaaggcagaggccggaacaaccgtattgattcgggaagggacatatgatgaaacgtttgaagtaaagcacagcggcacggccgaaaagccgattacatttcggaactatcagaatgagcatgtcgccatcagcggcaaatctgcgccaaaaagcgattctgaaactccgttaattcaaatccgcaataaacagtacattaccattcacggcattacgcttgagaatctctccgtatcatcagaagatgcgacggccatggggatctgcgtcaccggatcaagcagtcatatcaacattgacggcaaccatatccggaacattaaaaccacggctgatgaaggaaacgcacacggcatcgcattttacggcacaggcgccatgaaggatgtcagcatcacaaataatacggttgaaaaactgacgctcggcgcaagcgaagcggtcgtgctgaacggaaatgttgacggatttaagattgccggcaataccatccgggacaataacaatatcgggattgacgtgatcggatacgaaggaacatccaagcaaaacgactatgcgcgaaacggcatcattgaaaacaatacggtgagccataactcttcttacggaaatcccgcttacggagatgaatattcagcgggcggtatttacgttgacggcgcagaacatgtggacattaagaaaaacaccgtttacaacaatgaccttgggattgaagccacctctgagcataaagggaaatacgcacgagatatccggatcacggataacaaggtgtacggcaatgcttacaccggtatttcaatcggaggctatgacacgaaacgcggcggcaccatcaattcggtgatcgctcacaacatcatgtaccgaaatgacacgaaggaccttgacggcggccagctgctcctgcagtacggcacaaaagggaacacgatcgaaaaaaacatcatgacggcaagcgattcacggatttttatcgcaaatgattttacgaaaaacgaagaaaataccgttaatcataacgtctatcacaaagaagagggaaaagacggtatctggaattggaagaacagagaatatgattcattcacagcgtaccgaaaaggaacggcaaacgattcggattccatttatgcggacccgatgtaccgagacgaatcgtcttatgactttacattaaagcccggatcaccggccctgtccgtcattcagtaacgagaccattaaaaaaagccagtctatatcagactggcttttgtatttatacacgaaggaatttccggatggaagtcagacttccccataccccgatcaccgcgccgatcagaatgagcacaagtgatacttggaacacaaacggactgtacggcagaagtgaaacaaatgatccctgaactttcggggccacccaagcgaccatcgactggtacgtactcagcacgagagcgatcggtatgacagaaccgaatacccctagcagcagtccttccaggaagaacggccagcggataaaccagtttgtcgcgccgacaagcttcatgatttcaatctcttttcttctggcgaaaatcgtgattttaatcgtattcgaaattaagaacatcgccgtgaacagaaggccgatgattaacgcaatcccgatgttgcgtgacaccccgacgatcttaaacagacggctgacttcttctttcccgtatgtcactttatacacatgatcaagcttctcaatttttttcgcgactttcggcgtatcatgcggatctgtcgttttgacgataaacgcgttgttcagcgggttttcctgatcttgcattttcatggcctttccgctgtcgccgaagcttttgaccaattgatcaagctctttatctttagatgaaaactctacgctttggatacccgagatgtctttaatctcattctgcagcgtatcctgcgttttcttatttgacgtcagatcgattaatactttaatttccacttctttttcagcatttttagccatgttgtttaagttcagcataatgactaaaaacacgccgaccaaaatcaatgtaacggtaacggcactgatggatgcaaatgtcatccacgtgtttcttccgagagacttaaaactctcacgcaaatggcgcccgagaattttaatcataagaaccatactcccctcttgactcatcacgcacaataattccgtcttcgatcgcgatgacccgtttcttcatggtgtttactatttctttattgtgtgtcgccatcacgacggtcgttccgcggttattaatctcttccagtgtcttcatcacttcccatgatgttaccggatcaaggttgcccgtcggttcgtcagctatcacgacgtcaggattgttgacgatggatcttgcgatggaaacacgctgctgttctcctccggaaagctggtcgggaaactgccgcgctttatgcttcagctgcacaagatcaagcacttcgagcacgcgttttttaatgactgactgctgctctccgataacctcaagcgcaaacgctacgttttcaaataccgtcaatttcggaaggagtttgaaatcctggaaaacaacacctattttacgccgcacgaaaggaatctctttttctttcacagccgcgagatctttatgattaatcaatatttgcccttttgtcggtttttcttctctgtaaatcattttaataaaagtagatttaccggctccgctcggtcctacgacatatacaaattctccgggatgaatcatgactgacagcccgttaatcgcttttacaccgttcggataggatttatatacttctttcatctctatcatgaaatcacctaatcttttatttatgtcttgcagccatagagttcgcaaacgtacagcggtttatggccgattcgtcaggaaacagatgaaaaatctgaaagttccttttcctcagtacacttcattatacgtcaaatttagacatattactattacagtttcttttcattcccagaccgagaaaaaaccttgcccctataacaggcaaggtttttctgttattttttctgtgacagccattttgcgatcttcgcggcttcctcatcatttacaagatggctcggcatattgccgcgtccgtttttaatgatgctttcaattttagcttcatcatacttcccgccgacttcctgtaaattcggacctccgccgccttctaagtctttaccgtgacagccgatacagctttgctgataaagttcttcacccgctgacgcagatgcttttgatccgcctgagctgtcagagctttcttttttcgattcattggatccgccgcatgccgccagcaggacggacatggtcagaaccagcgccagcagcgcccattttgatttcatatgtaagatgcaccccttcgctattataacctcgtttactcgcgtttgaaaccctcgccgagcacctcgcttgcgtctgcgacaatgacaaaggctgactcatcaatttgtttgacgatttgtttcagttttgtgaattcggtctggccgacgacacacattaagatcggccggtcatgttccgtatacccgccgactgcggagatcttcgtcacacccctgtcgatttctttaaacacagctgatctgactgcttcttcatgctgcgtaatgattaaagccattttggagcggttgaacccgacctgcacgacatcaatcgttttgcttgaaataaataccccgagcatcgcatacagtccctgctccactccgaaaacgagcatcgcgctcagcacaattaatccgtccatgatggcaaggcacgttcccagcgacagccccgtgtatttgtgaatgatctgcgccgccagagccgttccccccgtggagcctttgccgagatacacgatgccgattccagttccgatcccgacgcctccgaaaatcgccgccagcagttcatgggtcgtcgcggcaggcagatctcttgttaaaaagacggcaagcggcagaacgatggaaccgaccagtgtcttcattccgaacttcccgccgagaatgatcactccggcgataaacaaagggatgttaataatccactgcacataagccggttcaaaaccaaacgtttctaaaatggtgctgatcccgcttactccccccgctgctatacggttcggcagcaaaaatacgttaaacacgacccctgtaatcgccgcaccgatcatgatatatatgtaatctttgatcagacggagcggcttattgtgattcacatccatgcaaaatcctccgttctccgattttctctcgatagcattttaagtcttcccggcttagaagtaaataacagccaaataccgtattaatttgctaaagcgtgttgtgaaaaatggaaaaagagaacggataaaaaaacacaccttgccaaaggcaggtgtgttcccggattacgacagtttagaacgtaaataggcgtcaatgaagatatcgatatctccgtccataaccgcctgcacgttccccatttccgtattggtacggtggtctttcaccatggagtacggatggaagacgtacgagcggatttggctgccccagccgatttctttctgttcgccgcggatttcgtcaagctccgcctgctgttcttcaattctgcgctgatacagcttcgctttgagcattttcatcgcccggtcgcggtttttgatttgtgagcgttccgtctggcacgtgacgactacatttgtcggcaggtgggtgatccgaacggctgaatcagtcgtattgacgtgctgtccgccggcaccgctcgcccggtacgtatcaactttaatatcttcggtacgaatatcaatgtcgatttcttcattgaattcaggcatgacttcacatgacacgaatgacgtgtgacggcggcctgatgaatcaaatggagaaatccgcacgagacggtgtacgcctttttccgcttttaaatagccgtatgcattgtggcctttaataagcagtgtgacagacttaattcctgcttcatctcccgggagataatcaagcgtttcaactttgaagccgcgtctttccgcccagcgggtatacattctgagcagcatggaaccccagtcctgagattccgtaccgccggcgcccgggtgaagttctaaaatcgcattatttttgtcatatggttcactgagcagcagctgaagctcaaattcattcaattccttcgttaatgacttcagctctttctcaagctcttgctgaaggtcctggtcaggttcttcttttaaaagatcatgtgtcatttgcagctcttcgtgagactcgctcagctgatggtaggagttcacgtattctttcagaccgttcgcttcgttgatgacggtttgggccttctgctggtcattccagaattccggttccgccatcttttcatctaattctgcaatgcgggcttcctttgattcgaggtcaaagagaccccctgaagtccgctaaacgagaagccatattttcgagctctgccctgatttctgataattccattccattcacctcattaaaagatccggggcgccataagacgcagacccggtcatgttcgcttcatcagtcgagactattctgtccggccgcagcaatttttatatttttttccgcttccgcaatggcaaggcgcgttgcgtccgatatccacaactttgcggaccggcgcttttttcgcttgtttggcctcatcgccgtcctgcggctgatgagccgtcgtttggccctgaacaacttcttcgcgttccaaattgctttcaatctcggccttcatgacgaatttcgcaacttcgtcctcaatggactcaatcatgtgctcaaacattgcgaaaccttccatttgatattcacgcagcggatttgtctgcgcataagcgcgaaggtgaatcccttgacgcagctgatccatcgcatcaatatgatccatccattttgaatcaacggcacgcaatacgatgactttttcaaattcacgcatctgctctgtaccgaaattctcttctttttcattatatttcgtcatgatgcggtccatgatcatctcatgcatttcgtccggttcttttccgaagatatcgctcttttcaagcgcgccttcatcaagatacgttgtattcaccagctccacgaggccgtcaagattccattcttccggaagctcctctttcggcgtataagcggcaatcgcacgctccagagaagacttgatcatgccttccacaatgtcacgcaggttttcagagtcaatgacttcaaaacgctgcttgtaaatgacttcgcgctgctgacggagcacgtcgtcatattgaagaagctgcttacgtgaatcgaagttgtttccttcgacacgtttttgagatgattccacggcgcgtgacaccattttgctctgaatcggcgtggagtcatccataccgaaccggtcaagcatcgccatcgtccgttcagctccgaaacggcgcatcaattcatcttccattgaaagataaaattgtgtgatgcccgggtctccctgacgtcctgaacgtccgcggagctgattgtcaatccggcgggattcgtggcgttccgtaccgacgaccgcaaggccgccaagctcttttacgccttcgccgagtttaatgtcggttccgcgtcccgccatgttggtcgcaatcgtgacagcgcctttttgtcccgcttcttcaataatctgagcttcacgctcatggtttttggcattcagcacctgatgcggaatccctttgtttttcagaagtttagaaatcaattcagacgtttcaacggcaaccgtaccgacaagaaccggctgtccggtcatgtagcgctgggcgacatcctccgccaccgccttgaatttcccttccattgagcggtagatcaagtccggacggtcgtcacggatgaccggctggttggtcgggatggatacaacctgcatgttataaatattgcggaattcttcctcttccgtttttgcggtaccggtcataccggccagcttttcgtacatacggaaatagttttggaacgtaatcgtcgccaatgtcatgctttcattttgaatttccaggccctctttcgcctcaatcgcctggtgaagaccttcgctgtagcggcgtcctttcatcagacggccggtgaaggaatcaacgatgacgacctggccgtcctcaacaacataatccacgtctttctgcatcgccgcatgggcttttaaagcctggttgatatggtggttcaaggccacgtttttgacatcaaacaggttgtcgatgccgaacgttttttcagccttcgtcattccttcttccgtcagctgaacgcccttcgttttgacgtcatacgtataatcctgatctttcttgagcgtgcggacaaacgcatttgcctgcacgtacagttttgtggacttctgagcttgtccggaaataatcaatggcgttctcgcttcatcgactaaaattgaatcgacttcatcaataacggcaaaatgaagcgggcgctgcaccatttgttctttatagagcaccatgttgtcacgcaaataatcaaagccgagttcattgttcgttgaatacgtgatatcggctgcgtaggcttcgcgtttttcgtcttttgacaacgaattcaggttcaggccgactgtaagcccgagaaactcgaaaatttctcccatttgctgggcatcacggctggccagatattcgttgaccgttacgacgtgaacgccttttcccgttaacgcgtttaaatataccggaagggtggacgtcagcgttttcccttcccctgttttcatttcggaaatgttcccctcatgaagggcgatgccccccatgagctgcactttaaacgggaacatgccggttacgcggcgggaagcttcacgaacgacggcaaacgcttcgacaagaaggtcatccgtcgtttctcctttttcaagccgctctttaaattctgccgttttatttttaagcgcctcgtcagaaagattttcataatctcctcttacggcatcaatgtcatttgctattttttcgtatttgttcagcgcacgtttggtcggatcaaacattttatttaaaatcccaagcatctataacgctcctctatgttcacatgcagattttgcatggaataaatgataattttctgtccatgtatacctctcattatcataacataccttttgctatttccaaagaatttgcagataaagatagagaaaaaccttccgcgcgttcacggaaggctggatgggtttattcagtcggttcaattaatccgtatttgccgtcatttctgcggtaaacgacatttgtgagattcgtctccgcgttggtgaatacgaagaaattatgtccgagcatattcatttggagaatcgcttcttcattatccatcggttttaaattaaaacgcttttgacggacaatttccgggctgtcatcttcaatttcgtcctgaaccgctacgcccgtatcagcagcgctgccgttctcgaaataatgtttcggaagaccctgctcgcggaattttcggttgacttttgttttatgctttcggatttgacgttccagcttgtttgttgcgagatcaattgcattgtacatatcctcgttatgcacttcagaacgaagcgccagatcagtcatcggaatggtgacttcaactttggattccttatcgttatagaattttaagttgacgttcacatcggcattgacgctctgctcgaaatatcgttccagcttgccgatttttctctccacatgatcctttaacgcaggtgtaacctcaatgttttctcctctgatattgtagttcatcaaagaacgcctccctttatctaaggatatgtaactatttctcttttaccccttctgatccctgctgaaacgttaaaataatgtgtaaattcggtgaacgatgacgaatggtgtcggttttatccggcagcgtccggcaggattataagtatatgcaaaggacgcaggcaaaagacctgccgcttgcagcaggtctagtgaagaacatacggtttgatgcagtcgtgcgtctgctccatccatagcttataatgcggcagaaagatggtttttaaaaactcctgaaaaggggcggacgggaaatcataatcatttaacatgctgaaatcctgaaagatctcgtcaaatgagcggatcgccgtttccacgcatcggcactcaatgatagacaacagaagcgcatgagaagaatcgagatgaaaaaaagcctgaatcaaatcgttgtaaatccgctcgccctccgtcttaaaaaaatcgtcctgcgtgtccaacaggtagcaaagcccctcatcaatcgtaaaaagaagctggtaataggctgacaccaaatggtaatcgttcaaacttctcaaaacactcacctatttgcgtttgtcgtaataacggccgtcacttgtcgtttgctgatacggattgaaatacgtattatggtagattcgttttttcttaagcgtttttatttcatttcggatgccatcctgaatccgtttcacttcgccggtaatcagacggtccatcgcggccacctgctgaagcagcgttttttcttcttcggaaaaaggcggctttatgcccgcaagcatctcctcccttttctccgtaaatgccgtaacgctgctgatgagaccgtcgctttccggggcgtccttcagtgcggcgtacatgttcttcgtttcgttatacaaagcaaagacattgctgttcatcaggcaaggccgcccgcgccatggctgtttttccgttcactctgcatggcctgcttccacgtgtcgcgaaattcagtaacgagcttttccgcttcatctaaaaactctccgttattctgcacgttcgcatcgatcagccggcggcggatgtaatcatagattgatgacatctgctcagaaatctcaatctcccggtttaacgtgatgctgagctcttgaatgatgttttgcgcctttacgatattttcatttttggcttcaaggttgttttgcttcatcgcctgccttgccagcttaatgaatcgcaggcagccgttataaagcataagggtcagctcttccggagcggctgtaaagacggatgtctgctgataagcagcaaaaggattatttattgccatttttataaaacctccaaggttatgatgttgaagatcctaacattgacgtgagatatgaagattggctgttcaatttctccaatgccgtatccagtgcgctgaactttttataatatctcgtctcgatgtcatccagcttcgttttcatattggaaatatttgtttctatttcatccaggctttttccaatggcaaagctggttgataccgagctttccgtacccgcctgttttgaaatttgggtctgcattttgtttaatgtgtcttttaatctccgggcaatcccctgttcctccgggtttttggttttcgctgtatcagggctgtctgcattaaacagtttagccacaagagcaggattctcggtaattttctgtttcagtttcgcttcgtctttaatgacaagctttccttgatccgtataactatcagacgtctcaattccgaaatcggcaagctgatattttttcccgtcaatcgtaacggttgagtacagatcaagccgcatctccgccaaaccgttctgcagcgtgctgtcactccgtaataaaccgcttttagcttttgcctcccactgctcaatctgcttatcggtcatcgcttctctttgttcatcggttagcggcttataatcacggtattttgattctgtcaccttctcgtttgcgcttttaattaacgtattgtatttatcaacgaaatctttaatgttgttaaaaatgccgtccgtatccgtcgtgctgttaatcgtaaccgttttattgctgtccgtcacgctgttcagcgtgtatttgatgccgttgatcgtaaagttattggacgtttttgtcatttcaagcccgttgaacgtaaacttcgcgtttttcccttcggcattggccgtcagttcatttgttgcatcatcaacggcaaaaccgagctgatctttcagaaagcttttggtcgcgtcatcacctgctgaaagggtaaacccttcccccgttttattggaagtgaacgcaatcgtgtccacataatccgagccgttagagattttctcttttaaagccgtcactccgagacccgagctgttcagtttggtgaccacatcatcaatcgtatcggttgcggcgatcgtgacgtttacctcagtcggcttcgtttcacccggatttgtgacattgaatttcaatgtttggctttgacccgaagtgaaattgatggcccctgaggatttataagtcgtcggcgtagccagctgctgtacagacatgctcgttgaaatattctgctcagcactgacggccaccgcgctgacactggaatccgaacttgttactgtttttttattccagtttgtggacatcagcatattattaaatgtagtagaatacatgtcggcaatctgggtattcatttcccgataagcatcgcgcttccattcaagcgtctgcttttgctggtttaatttattaagcggctgcttttcggcatccatcatttttttcaccagagaatctacatcaagaccggaattaaggcctgtgattcttgtgaccatatgtaccctctccttttcggcgtttagtcgtagacggctctatgacaacagtgagtttccgactgtttatcatatcacagctccataaatgtatgatcttattcttatatcggtcatattaaaaggttttcaataatttaactgcaaaatataatgtttcattttgtcaatagggttctttggcttgctgaaggaggagttagctgaagaaataaaaaaagaccctggagaaccaggatctttccgtcattaacctttaagcaattgaagaacttgctgaggctgttggttagcttgcgcaagcatagcttgagaagcctgagtaaggatgttgtttttcgtgtactccatcatctcagaagccatgtctacgtcacggatacgtgattcagcagaagtcaggttctcagaagaagtaccaaggttgttgattgtgtgctctaaacggttttgaaccgcaccaagtttagcgcgctcgctagatactgtgtcgatagctgttttgattgttgtaagagcagtagatgctgcctccgcagaagtagagatatcaattcctttagtagcatccccaacagcaagactttcagaatccattttattaattgaaagcttcatagtttgaccttcattggcaccgatttggaaagtcaggtcagttgctgtaccatcaagtaatttctttgtgttgaattctgtgtctgtagaaattctagttacttcagaagaaagctgatccatttctttttgtaactcagcacggtcagaagtagtgttcgtgtcgttagccgcttgtgtagcaagctcgctcatacgctgaagaatgctgtgagtttcgttcaatgcaccctcagccgtttggataagagagattccgtcttgagcgtttttagacgccatgtctaaaccgcggatttgagaacgcattttttcagagatcgcaagacccgcagcgtcatcaccagcgcggttgatgcgaagacctgaagataatttttccatgttttttgcagcagagtttgaacctgcattcagctgacggctagtgttaagagccgcgatattgtggttgattctcattttgtatttcctccctgaattgtttttcgcacgtccttgtgcatttgcgcagcgtcatttctgaagaaaatttttcctctcattggctacaatatatatatcggatggccgcttctattgtttatattgaaaataaaaaaatcctcactttttttgtgaggataagttaagtaataaatcagtattaaaagatacggctctgttgttctcttccaggatcgacaagtagatttctttccggtgaatatctacgtgctgaggcgcttcaattcccagcttcacttgttctccttcgatagcgatcacctttatttcaatatccggcccgatctgaatggactcattcacttttcttgagagaactagcatgatcctcctcctatcagatgttttgtttcataggaagcatcatgtaaaatgatttgtttcgccttcatttcctttttattgacgataatcggcgcttttaaattggcggtcgtgttttcaaaaggctcttccagtgttaaaatcgccatcacttcgacgtcctctatatcttcaatgtgcaaaagctcaagcgtcgcttggtcaatgtcaaattcgtaccctttaaagaaaataaacggactggcgacaataaaggcgatgtgctcctgtttcacagactgcagcgccaaaaacggtgaatcttccgacaaaggaagaacaacaaattgagtctcttcattaaatcccggcaggccgttttcaaatgagataatctgcccttcatctattctgatttctccgtgatattttgttttaattatcatgcttcacaatcctttaccactttcatcttttattctgcgttgccatcatcaaccgaaatcgtcaccttagggtcttgcatcatatcaatctgaactttccccggcgtataattccatacaggtttattgacggctgcttcaattgaaggtttgcgggcttcaatatcaatcgtaagctttgaaggaatgcagtcaatgtcgacgagaaactgcgcaggcagaaagtcgctgaattcgccgaatggatcgggcggactgacatctgctgcctgccgggccatcacattgcccgttttcttttcgatagccgccatttccttcccttccctgactgtttttgcgataaactcgctgcaggcttccgcacctttttgagcggcttcagcgttcagcttttcaaatgatttgagattcaagttctcccacgccctcgtctggtcaatcgtcagtttggccggcgtgctttcaatgttcagctctgccggcggctgctcgatttccaggtcagcgggcggctgttccatctcgatttcttccttttgaaaggttataccgattttagcaggcacactgtcaataatcaatctcggcatctgcacagagatccctcctatttatagtattttagtaaaaaaagcgatctccctgttgtgagtcgctttttttatatattgaagacgatagttatattattttaggaagtcgatcagtgacggctgaatgatattcgcattcactgacagcgctgctctatgaaccgtctgttgagataaataatcaacaattacatcttccatttctacatcctcattatccgacaatactttttcagcggttgccgcttgtgattccaatcttgtctgaatgagttccaaccggtttgtgcgtgccccgatattggatttttcagcattcattttgtcagtaaaaccgtcgatatctgacagaatttgatttgaatctgcttcggacagcgtgcctttgcttaaagaagcttctaaggagttgagaaattcaaatacattatctccattttgtgcgacgcctccgaaagctgagtttggatcagaattcactttcagcactgctccgtttgagatgttgatgttaacatccgaagcaccggtataattctcatagttgtacgtatatgtgccgtcggcattttcagtgatcggcgggacgtctgaatttgttccgttaaacagataacgtccgtttacctgagtattcgcgacagaaacgagctgctttttcagctggccgatttctgtaccgattgctttcaattctgtttcaccgttcgaatcacttttcgcctgaaccatcaaatcccggattttccccataatatccgtttccgagtttacgcttgattccgagttttccagccatgtaaaaccttgcgaaacattccgctgatactggtttacctgcgcaagctgagtacggtactgcattcccttcattgcgacgaccggatcatcagaagctttcgtgatttttttccccgtagacacttgctgctgaagccgatcgagcttgtcataacttgagccgataaatcgaagagaattttttgcgatcatcccttgagttactctcatttacttatctcctatcttcctccggtgcccataccgttaataattttatcgaatatttcatcctgcatcgttatgatccgcgcagccgcattataagcgtgctgaaactgaatcatatttgtcatttcttcatctaaagacactgcactgactgattgtctccgttcatcggctgaaagggtgttgctttcagagttgttcataagattggccgctttttgtgaattaacgcccagctttccgataagggattcataaaagtcattaattgtagtggtttcaccattaatagtcagcttgctgttctgtacggctgctagatttgtcgcgtttgtgccgtcacttttttctccgtttaacgacgctgcgatattatcagtagacgcaaggattttgtcactgacttttattttcgctgccgcaccttttgccggcaccgcttcaccgccgctgaagtcaaaaaatgctgcaccctgttcgcctgtataggtcttccctttttcatgaactgcattaaacgcgtcagcaaaggatagcgccatattgtcaagagccgtcagcatttcaggataaagccctttttcttctccgtttgacatatagccgtatgattcaataagacctaaaagtgagccttttccggtaaatgcatccgcattgaccgtactgctgccgactgacacactcgacacgagtccgctgtccttgtcgtagttgattttcatttctgaaactgtttttgtgttaccgtcgagcagcgtaccaagagaattgttgtttccattcagcaattcgacgttaaccgtgccctcagcagtcgccaaggcatgtccgcccgacttattatatgaaacttttatatttgccatagaagataattgatcaatcaatctgtctctttggtcatacaaatcattagggagcataccgctcggctcaactgccgctatttgattgttaaggtcattcagctgattgagaatggaattgacctgatccgctgtgttatccaggttctttttaatatcaccctgaatgttagtcaaagaggtagatatatagttaaaactttcggcaagagatttcccctgctcctgcaaaactgagcgcgctcccgtattttccggattcgtcgccagatcctgaagggcattccaaaacgaactgagcgatccgtttaatccgttattgtcaagctctttcatgacgccttccatttgcgacaatgaattggaacgggctgtatagtaccctaattttgtattttccgttctgtactgatagtctaaaaaactgtctctgacgcgctcaactgaaccggcttttactcctgttccgatttggccggccgtcagatcactgttttttgatactgcgggataaggactcgtcgattgtaatgtgacgcgctgcctcgtatatccttctgtatttgcatttgcaacgttatttgaaactgtgctcaatgcagtctgctgcgcactcaatgcacgccttgctgtttcgagccccataaaagtcgatggcattgaaaatcctccgttctaagcttttgaatcgaataatgtcaaacggctgacaggcttgcgcgccgcttgcggctctttataattcatattctctttttcacccggcatgatcatatcgaatgcccctgagatgaattgtaaagcctgaatcgtgagctgtttgttcatctcattcacttctttcagacggtcaagaagcgcagacaaagagtgaaataacccttcaagctcctgtttttcactgcctgaagttctggagatgcatgcagcaattgtattgtcctcaccgcggctgagaaactgagaagttaacctgattcgttcttcctcagtctgcccgattgcctgaatatacttttgctctttagtcaatatgttggagagctcttttgttttacctgctttcagcgcttccgttttctcctcagacagcgtgagcagatgttcatgcagtgcgcaaagtcgcttcagttgatcaataattggctttgctgacattggctttctcctttttattgctttttataaaaattcactatgttttcagcgatgctgtttgaatctattttatatgttccgctctctatatccgctttaagctgagcgattttttcctgacgtgttttagtgaccgcatctgacgcattttgaagctcttttgcatgagaagaaatttccactttgtccttcggctttgcagcctctttttgtacggcttgcttttcgtaatttttttggtatggattaacggattgtgttccgtactgattgattttcataggattcctctcgctttctgttcgcagtctaattcttttatcgactgcgttatcagttagtttagggaatcaggtgtttttggtattataggcatagtatgtgtcttttgtactgtttttttctttggattcagcggctgttttttggttcatatggtctaattgtgactcaatatctgtctgacaggacttgcaaaatttccccgtcctgatcggatttccgcacctttcgcaaggatatgccaaatttggaagctggctgatctgaatccttttttgtttgataaacttgaggatcagctcttcatccacacctgtttcctcagtgatctgctgcatcgtcgactgtctgttgatctgctttctcaaaaatttatagacggtttcaaatgctttttcttcttctttaatacatgcctggcacacggtctgcaggttcgttttaaaaaataaagcattgcattttggacaattcgccaattcacccatcgtattaactcctattccttctttaatctgccttatatttctatcaattatatcggcagaaaaaaagaatgatttagctcctgattaaagtaaaagaggagaccgatgacgctttacccgctgtcagcaggacttcggcggcttgatgcagtgtggcgcccgtcgtataaatatcgtctattaagatgacgttcataccttcggccgagttttcggctgctgaaaactttttttctgcggacagcctttctgttttgctctttttggattgtttttcattgttcagtcggatgagggggaaaatgacgggcattccgagcagagaggccagcagctcggattgattgaatccgcgttccgccagccgttcgccgctcagcggaatagggatgagagtatgtgtatttgatggatatgccgctttaaagccggcagcaaagtcacgtccaaatgcttgaatgattttcgcatcacccctgaatttaaaccgggctaatgagtccttcatcgcatcattatacaaatataccgaacggttttgccgcagcaaaaagcgcttttccgtttttgattcccgggccgcacaatcagcgcatttttcatttgactcctgaggcctcccgcatatagtgcatacggggccttcaattttttcgaatcggctgctgcatatggtgcatacctcttgctcgggcgccagagaaaacagagatctccaagtcaatgaacttgaaattggtgagtcacacaataaacaattcagagatattacgctccttcccgagtttcacagaactcgcttggattaaccgaaacaatcgccgctgattcagccagaatgacaagcagcgctgtatttttctgtttatcaactatctctgcttttgcataagcaactttctttttatctgtaacatatgccggctcagcccggtttaatgaaagtgctagtacatcatttttgcatacccggcatgtgcatttcatatgaagctgaggcatatggcggtcgagaagttcctttaatatgatttctttagaattgacaagcatgctgacagctcctcataggaaagtatgagtatactgtatcacgttttctgaaattaactagtccaacaatttacttttttgtgccaatttgttcatatgttctatatgtttttttgcttttttcattccgtttgtcattccgaaatgaaacatgacgacatcaccgctgaaatgtttataatgccttcccgttctgcccgcgatctgtacgagcgcgctctcagtaaagataggtgcttctgcgccgaggacacatgtctgaactttgggtacggtaactcctctttctaaaatcgtagtcgttaccagcaggtcaagcaggccgtctctgaaccgtttcactttatcctttctgaatgtgtcttccgcatgtacgccttctgcccgtatgtttaatttctgaaaataatccgttgtctttttcaatacgtgtacagacggaacgaataagaaaaccggcagctgtgattgaagtttttggcggacccaatccgttacagagcgcggcagttttcctttctgaagcttcttcttccaattgccgcaccacaaaaaacgcggctccgggagaggtttccgatgatatctggccggtatgcgaacgcttttcagcaaaccggcttcagcattcttttttaatgtgtctgaaggagttgccgttacataaacaagggcgctgtttttcttcctcgctttatcaacagcgaaccttaatgtctcatcggctgaaaaaggaaacgcatctacttcatctattatcatgacatcaaaaatgtctcggtagcgcatcagctgatgagcggttgaaatcatcagcggagtcaagcggcctttgtcctcgctgccgccgtacaaagcagaaacgtcgactttctcaaatgcttttttcagtctcggcagcagttcaagtacgacatctgtacgcggagtcgcgacacagacgcgcaaaccgtgattcagggcaaactcgataccaggaaacagcatctctgttttccccgatccgcaaaccgcccatactaacagctcttgtctctcttttatcgcatctgtaagcgcggcggcggcctgcttctgtccgtctgtcagtgttccttcccaagaaagctttacaggcttccagctgttttcaggggcttgattccaagaatataacgatgtcagttcatcagcccttcccatcatgacacaggcacggcaataggtgatctgccttttggcagagggcgcccaaaatgccgcaaagcaggcttgatcagactgaccgcatcgttggcagatgtaacggtttttccggcggatgattgacggctcggccgttatatactctttttctataaaacggttgatgcgctgatctgaaaacggtatctcagctctcaataaatgtcggccgtaaaagaaatcccgcacctctgaaaattctgaagcaccttcggccatctccctgcctcctttctgctcaaagtatgcctgccgggaatttttttgtcgaatcacgaaaatttaataataaaaaaatctccgcccttgaaaacggagattttcacttagtttttaaaacaccagccgattccgatggcgccttcgcccagatgggttccgatcacggcaccgaaatagctgttatagaattcgacatgaggatatttaccgcttaactcctgtataatatccgccgcttcttcttccctgtttgcatggatgacagcggcccgcatcgggattcctttacttgcatcctccccaaacagctcaaaaattctcgaaatcgcttttttgcgtgtccgaatcttctcaaaaggaacaattaccttattgtcaaaatgaagaataggctttacctttaacagaccgccgataaaagcctgagcactgcttagacgcccgccccgctggaggtgtgataaatcgtccaccataaaatacgcacggactgtttttttcatttcttccagctcttttataatctcttccggtgagtcaacaccgtctttaatgagctgtgctgcctttaatgcataaaaaccttgcgccaaacagctgatctctgaatcaaagggataaactttaatatgatcaaccatagtgtttgccgaggcggcgctgttataagttccgctgattccgctggacaaatgtatgcttatgactgcgtcatatgttttgcccagttcttcgtacaatgcgattaattcaccgaaagaaggctgggacgtagtcggcagctcatcatgattttttacttctttataaaaacttctccagtcgagttctgtttcttcgcggaatgttttttcaccgaaaaccacttgaagagggatcatatgaatatgatgttcttctctcatctctttcggaatatatgctgtactgtctgttacaactgcaatcttcatcactttacctgccttattaagtacttaataagtattttaatagatatgaagctgtaaaaaaagacttgcctattatggcaagtcttctcatacatgactaacgcatctctacccagccgtttttaatggctacgacaacggcttgtgtccggtcattaacgttcattttctgcaaaatattactcacgtggtttttcactgttttctcactgataaacaatgattcaccgattccgcggttgctttttccgtctgcaagcatttgcagcacttcacattcccgtctcgttaatatatgtaatggtctccggatttccggataaacctcatgctgaggatgagcagaaactccgcttgtcgcaagacggcggaattcgttgacaagattgtgggttactttcgggtgaaggtaagaaccgccctcggctaccactttcactgcttcgattaaagtatctgcgtccatctctttcaggagatagcctcttgcacctgtttttaaagcatgagtcacatagttttcatcatcatggatggagaggataatcaccttagattcagggtacagctcaacaagctgtttagtagcctctactccatttacattcggcatattgatgtccattatgacaacatcgggatgataatgctcgacgattcgagccgcctcatctccatcgtcaccttctgctaccacttcaaaggtaggttcaaaatccaatattctttttacaccctcacggaatagttgatggtcgtcgataataacaatatttactttagtcacacgctacgcctccttatcctattgttctatatacgccgctgttcggtcaatatgtcttttggctctatttaacaaattataggccgagagataacggaaccttaatcatgataaatgtcccaagacctattttagagtctatcgttatcgttccttcaagcagatctactctttctttcattcccagcaagccgaatgacttgtttttcttttgtttagcatccttaatatcaaagccttttccgttgtccttaatgataagaacgacaaaatcagcggttacttccacttttactgttatttcctctgattctgaatgtttgagtgcatttgtgacggcttcctgagcgagacggaaaagcgccacttcaaattgcggggcaagccttttgttctccgtgtctccgatacactgaaaatgtattttcacctttccgttgtattcttcagttgtataaagatattttctcagtgtcggaatcagcccgagatcgtccaatgccatcggtcttaaatcatatataatccttctgacttcgtaaagggcattccgcacattctgccgaagatttctgatttcctgaaatccgtcctccgtgccgcggtcgcggaagatccgttcaattaattccgatctcatcatgacatttgccagcatctgcgcgggaccgtcatgaatttctctggaaactctttttctttcttcctcttgggcttcgatgattcttaagccgaaatcttgtttagcctgcgcatcggcaagaagaagccctacttggcgaaggtcttgattcaggtaattcagaacgacggttatttggctgaccaatgattctgaccgttcaatgatttcctgaagccccaaaagccggcgttctaaatcatctctgcgctcccgcagctgcttttcacgctgctggatcatcgtcagttccacttgaagtttgtgcgccttttcataggcgttgcgaatttcttcttcgctgaacttatggaaatttctgctcacttcagacaagcggtttcgtgcgtgccgcgtatgaacttcaagtttgtcgcccagctcaatgacttcgtacacctgctgtttgatctgtttgagttcttcaaccagctgctcatattgctggcgcgactgctctccgatttgaaaaacctcgtccttgctcccgtccacggttttcagcattttcataagtatagaatccaaaactttggagtccatcttcgatttattcatctgtctccctccgtaacggtgttgttatgtatttttattataaatgtaattgaactgcaatttatgtcgaattataatgaaagaatgcgtatattctagaaaaaaacatttttatatagtatcttactctttcatgataccaaaatatgcgcaaaaattctaaagtctgttcgaatttgtagaaacaagtcttttaatgcttgtcaggagggtccagcaatcatgctgcacagctatttaacagttaaagaagcgggtgaacatgagattgtgattgaaaaatcacgttttatctgtcacctgagccgtgctgcttctgaagaggaagcgcaggaatttatacaaaagataaaaaaacagcactggaatgcgactcataactgctcagcttatctgatcggcgaaaccgaccatatacaaaaggccaatgatgacggagaaccaagcggaacagccggcgtccccatgctggaagtgctgaaaaaacgaggtctgaaagatacctgcgcggtggttacccggtatttcggcggaataaagctcggtgcaggcggattgattcgtgcatatgggaagtcagtgtctgaaggcttaaatcatataggagttacggagcggaagctgatgcggattatgcatacatcagcggattatacgtggctcggcaagatagagaacgaactgagagaatcagtttttttactgaaagatatccattatgcggatcatgtcgaatttgaaacgtacgttgaagaaaaagacaaagaagcgtttctaaaatggatgacagaactgacgaacggcaagagtaagaatacagagggagaactgacgtatttagaaacagacgtcagccctaaaggagactaatgtaatggctgaacgtgtaagagtgcgtgttcgaaagaaaaagaaaagcaaacgaaagatcatattcaaacggattttgctgctgcttaccctcgttttgttagtcgctgccggatttggcggatacaaagtatacaaaacgattaatgcggcagataatgcatatgatgccctttcccgcggagacaaatcaaaattgcgggataaagtcatcaatatgaagaaaaaaccgttctccattttgtttatggggatcgaaaattatgccaccagcggaaaaggcggacgatcagattctcttattgtcgttacccttgatccgagaaataaaacaatgaaaatgctgagtattcctcgtgatacgcgggtgacgcttgccggcgacacaaccggtaacaaaacaaaaatcaatgcggcttttgctaagggcggagcggatgaaaccgtctcaaccgtcgaagacttattaggcataccgattgataagtatgtcactgtcgacttcaatggctttaaggatgttattgatgaggtaggcggggtcgatgtaaaagtgccgtttgacttcgacgagatgagtgacgtcagtaaaaagaaacggatctatttcaagaaaggaaacatgcatttgaacggtgagcaggctttggcttacgcgcggatgagaaagcaggataagcgcggagacttcggccggaatgaccgccaaaagcaaattttaaacgcactgatcgaccaaatgtcaagagctggaaatattgctaaaatcgataaaatcgctgaaacagcgagcaataacgtccaaacaaatatccgaatcactgaaggactcgctcttcagcagatttacagcggctttaccagcaaaaagattgatacactgaccataacaggatcagatttatatttaggcggaaccgcaactacgcgcggaacatattatttccagccggatccagccaatctcgaaaaagtacggcaggaattgcagaagcacctggattacccgtccggaagcagcacggtgtccgatcccgcttctgacagcaccggaacggacagtacaactgattcgacttccggcagcaccggaacaagcggcacaaccgattcaaccaacggtactgcaggtgcaaacggtacggacagcacacagtccggcggcacaacaggctattaagagtaaacccgatcctttgagcaggatcgggtttttctatataataagagaatagcaaaaaagcagaccattcgcatgatctgctctttttaatttttctttaccaatcttttgtaaaacttggtaaatggtttaaattgttcatttactaaccctgtgacctctgctatgatttgcataaatacaatcaatacaaaaataataaacagcgaaagccatatggtcgcacttttcagcaggatggcactgacgctgaaaataaagccgattaaataaatgataatgacagccgtgcggtgtgacagcccgaaggccatcagccggtggtgtatatgtgacttatcaggcgctgagatcggctgtttgtttaaaatccgcctgatgacggcgaatgtcgtatcaaaaatcggcacgcccaaaatgatgatcggaatgatgatactgaataaagtaacacttttataaagacctaataatgagagtactgagatgacgtatccgagaaagagcgatccggtatctcccataaatatctttgccgggtgaaaattataaaataaaaatccgagtgtgcttcctatcacgacaagtgaaagtgacagaataaggattttccccccggataacgccataacggcgatagtggagagtccgatgaccgacaggccggcagcgagtccgtccaaaccgtcaatcaggttcatcgcattcgtaataccgacgatccataacacagtcagcgggtaagcgacccatcccaattctaaacgttccgttaaaaacggtacggagaaaaagtccattttcagtcccgtgctcacaatcataatggccacggccagctggacgaaaaactttacctttgcgcttaattggtatttatcatcaaggattcctaaaataacaataataaacgcacccaccgtaatggcggtcatttttgtttcattatatatgccggccgcgagcacacccgccgctacgccgataaagatggccaagccgcccatacggggcattattttatcatgtacttttcggttgctgggctggtcaactgcacctattttgatcgcaattttttttacgataggagttaggattaaaaccgttagcagagagacaaaaaacgcaacaactatgcgaaacatgcgttcgtcaagcataaagaagtctcctttggaattatatgaagtcttttctgatattgaaccgttccttccattataattcttactagttattataacaagcatcatcaaaaagaaacacgcaaatcaaaaaatgcgctttcccttttaatgggattgcgcatttttcaatatacccgtgcattcgagcattcggccgaataaaacattccaatctcgtctccgggccaattcacggcgcaaagcctcgtatgatccgcggcggtccgctgccagaagcgcttcgcaggccgcgatgaaatctgcggggtcgctcccttcaacgtattcataaacgtaaggccttttgatttttgacgtagaagaaaggttgcagccgacaaccggtttcccggcggctaaaaattcaaaaagcttaagcggaaataccgcgtcattataaggtgaatttttatacggcatgatgccgatgtcgacaagctgcatataggacggcacttcattcggcgcggcaggtcccgtccagatgacattcgggcgttccagaagcgactcgaaatccggatcgtcctgagccgtgttcgggcccaccaataaaatcgtccagtcaggccgcacatctgccgtttccgccataagcgcaaaatcgagcttcggtttgattccgccgataaaaccgagaaccgttccgttccgtccccgtaaaatgtcttcatccggctgtttattttcccgtgaaaacaggtcatattccactccgttttcaatggtgaacactttctggtgcgggttctccagcttttttccgacctcccggtgcagacagtcagatgtgcaggtgatggaatcggcacgctgaatgattctcatttccgcctgtttaatgatgtttcttcttacatttgacagcacaccggcccggccgctgatcggagcggcccacagatcactgcaatcgtaaatcacttcatcccaaggaaacagatctgccagaagcggaaaaccggggaaggtgtaccataagcagcagcgggccccttctccttcttccttcagcatgtgcaacaatggtgaaagtttatgcctgtaacacatgtctgtatacctgccgaaacggaatgctttttgctgcatgagatcctttacagtgaactgccggattccctcggcgatcccggccgtctgaccatcattggctcgcggggacgggcatacccaaatgacgcttttcgtttctttttgccgggcaagaaattcagccagccggtgccgtctgtatctcagccggtcatgcccccattccgccgctccgacgattacgtgaataatcggttccaccttcatcacccagctcctctgacgcctacagtcttttcaagaccgcgtttttcgcatattgcataaaacaccacgaagccttgataaaatgcaggcgctcaatttctctataaacaaaccacgttttttttgcggctttccacttgttgcttgaaatcgaattctgcacaagcctgtattctgaaaggcactcattcaggccgtaagccgtaaatccccttttcagcagggaaagccatgtcgctaaatcctgccgcgttctgatatcaggcatttgaatctgccccgtctgctctctgtcaatcatgaccgttaaacatccgataatcgtgttttttaaagcttcatcatatgacaggctttcaggggcttgaatcgttttgtccgtcggcgttccgtcctgctccatgacgctgtagcccgtaaatgaaaaagcgcaggaacgctccgccataaacgcaagctgtttttgaagcttttcctttttccatctgtcatcgctgtccagaaatgcgacataacggcccttggcatgtttaagggctgtatttctggcagccgcggctcccccgtttttatctaaataaacgacgcggatccgctcatctttttgttcatattgccgtaaaatatctctcgttccgtccgttgaacaatcatccgcgataatcatttcccaatgcgggtggctttgatgtaaaacggactgaatcgtgtcttcgatatattcacttgcgttataagacggtgtaatgacagatacgaaaggtttccagtttgtcatggtcacatctccatcgcagattttcacaaggactctctaaaaaactccggaatgacaatgaacataaaggcaactgcaatgccgattaaaacgcccagaaccgctttctttttcggcggcatgccttgtcccgccgtttcattcatcggctctgaattgatgacgccggccgctttcaggttcagctgcgtatttttcaattcgtataaaaatcgttccttatccactttggcgtccgcgctgacggtttctccttcaagcgcagcaatactctgccgcactacttttgcccgtttttcaaacaggtcctgatcattcttcagaaaagttgttatgacggcttgaaacaccgattcggtctcctgtttgttttggccgctgtagctgaccgtgatcaatgaatctgattgtgtttcgacagtcagtttacttttcacagccgctctttcttcgtctgttttatcaggcagagcctgctttaaaaaggcatcgctcgtcaaaaggagcgggatttcttttgtattgttataaagcggatgatcataatttcccgcggcgatcgcggcttctgatgtaaaactgctgtttccgcttatttttgacggcaatacatatcccgccgcccctaacacaacgggcagcgcaatgatccaaatgatattctttttgatacgccgggttattcttgtcaacatatccttcatctcgcatctccctgtttttcatagtacgccgtgacggcagactccttttgtaaacgcctcaatatattgaccgccgcgatcacgagcgagagaaatacccagtggaaaaataaatttgatacggagcttgggctgatgctgcttaccaaaaaaccggccatcgccgtgataagtccttctgtgatcagtcttgactgattttccgattttctttcatgacatttataaagtgtccaaaaaaggaacaaatagactgtcaggtaaccgagcatcgtaagcacgccgaagttcgccataatctcgacgagccagttgtgcacctcaactacgccgcccgtatcataaacgggctccgcttttaaatagtaagagacatttccggcacccactccgaacccccaggaatcaatcacatagtgaaaggcgttctttaaaagattcgccctcgcaaggttggaaggaagcggctgctgtcccggcatcgcctgcggagctgaaaacagattcaagacggcattggtgatacggcccgcaaataaaaccgcaaacagcgcagcacccgctcccgcagcgtacagcgcgaattttttcaacacggaaggcagcaggatgaagacgtatacagccgcccccgcgcatatgcccagcagactcgcgcgcgaaccggtcaaaatgattaaatacaaagcgcagatcgcaaagagcaggctgacggccttcacatagccgtttttcatatttttcaccgccgccgcatacagaaagaaactgatgcacaaaaacgtcgcgaaatcattttgattaaagaaaacggacgtcggataatgctgtttgtactgcgggccgttataaagcgtggagctcggcagatggttgtgtgtaaaatggttgtaaaagccgatcgccatcacaaaaatggtcatcacaagccatatgccgtaaaaaaccatcagctgatcaaagcgctgaatgaacatgacaataagataaatcaaaaacatgcccattcccattaaagctaaatatttaatcccgtacgtcacggattttgcccacaataacgataggagaccgtatgtaaaccataaggcgaaaaacatcagaaccccttttacattcacccgattccatctgtcaatatgatgacggtttgtcaggatgccggcgatgtgaagggcgcccgctccgattaataacagccggtatataaataagctgaaaaatccgagatgaaccgcaaagaaggcctggtttaaaaatgtacacgcgatcagtatataaatgagcgccataaacatctgaccgtttgttgtaaaggcggatagcaaagcaagtccggcaatgccaatcatggcggcaagcagcagcacggtgatttttccgaagccggcatccgccctgaccgcctccagcatgatgcatcctcctgtaatgacagcggcaagcagcacaagaacatgtgccgctgaacgtttgatactcacatggcaaacccctttccaaaaccggcagccgagccggactgccgagagcctgaaaacaaatctttttctatcttgccagttcttttatttgccgatcggcatgaaccgccggacgtccgacggaatgataagtgaatcctgaaaccctcatatactccaacggaaacatatttctgccgtcaatgatgaccggctgtttgagcagctgcttcactctctgaagatccatctccttgacttccggccaatctgttgtaatcaggcatgcgtctgcgtttttgatggcactgtacatctctgtgtgatattcaatgccgccttctcctaatatcgctgacgcttcgggaatcgcgatcggatcatacgctttcacgtgagcaccctgctctttaagacttgtgatgatatcaagagccggggcggagcggacgtcatttgtatgcggtttaaaggccagccccagtacggccacggttttcccttttaagggaccgatggcgcggttcaatttttccgtaatacggacccgctgcttctgattggtttcaatgacggcttccatcatttcaaacggatagccggcggcgtttgcgatatgcaataaagccgttgtatccttcggaaagcaggatccgccgaatccgatgccggcctgcagaaatttattcccgatccggctgtcaaggccgacgccttctgacacgtgagaaatgtccgccccgacacgttcgcaaatattggcgatatcgttaataaaagatattttggcggctaaaaaagcatttgcggcatacttaatcatttccgcgctttcaagattggtctttacgatcttcgtacggaacggcttatgaagctcttcaatgaccgaagcggcatgttcgcttgtggcgccgataaccgcccgctccatctgcatcgtatcccgcaccgccgaaccttcgcggaggaattcaggatttgacgcgacatcaaacggatattttccctttgacgcttcgctgacgatttggtaaacgagctttcccgtcccgaccggaacagtgcttttggtgacaatgattttgtatccgttcagctgttctccgattgtttgcgccgctgccttaatgtaggtcagatcggcttcacccgtctttgacatcggcgtaccgacggcgatatagatgatatcagcggctttcacagccggctcaatatcggccgtaaaggataaccgcccggcactgacatttttttcggctaattcctcaagccccggttcatatatcgggatgactccgttttgcaagcttctgattttcgcttcattgatgtcacagcaagtcacatgatggccgatttccgcaaaacaagttccagatacaagacctacataccctgttcctaatacagcgatttttttcacagcttcatccctctttcgaaaggttctcctcttgcccggcccggttcatgacggaccggtatttctctttcagcgctttcgcattgtggcttgcgtcaaaatacgtgcggacggtttgagaaagttcctcggctgtttgcggcgtccaagcctctccttcgtcatattgcaaaatggattctgccagcgtgtcaggtgaacccggcttgatcagcaacccccggtgtttcccgaataaagaagccaatcctccgacatcggtacagattaccggcaccttcagagcgagcgcctcaatgaccacagtcggcatgccttcgctgtaggacggcagcgccattacatctgaggccagcagatagtcctgtaccttgtcgttcggcacttgccccgtgacgatatgagcggcttcacgcaatgaagattcggcgggaccgtcaccgacaaagacagcttcatatctttcatccaatgactgaacggcttttgataagtcgaaaacacctttctctttgacaagcctgccgatgaacacgatcagttttctatccggaggaaggccgagccgttttctgacggcttctttcgtctcgttcctttttcggaaggcgtcaagcgtgatgccgatcggaagcacgctgcactccgcttcgatgagctttttcatttgttcccgcagactgccgctcacagcgtaaatatcggctgcttcccgcaccgcaaatgtaaatgcgcgatgagcgcttttgctgtaatgcggatagacattgacatcactgccatgcaaggtcagcacatacgggatgcctaaagcctttgacacaatggccgccgctccgcctgacggcatggcgaaatgcgcgtgaatcagatcgggcttcaggccatgatttttaatttcggaaagaaccgataacgccattcttttatgcggctgcgcccatttcagctgtccgggaaccgcctgataaaacggccggtggacggacacgcctctccgccattcatgcgccggccttatatccttttgccgatacgtctttttcagcacccggaatggcgcggcgagtttcggccgcggacaaatgacagtcatctccgcgccaagctttctcagttcttgggcctgcgtctcatgaaaaacgccttctcccggcttctcactgctcggatatacacttgtcatccacaataccttcatagcaaacgtccttttcttaatttacttttcatatgcggataagcttttcctaacaggaataaataacacaacgcgccgcaggctacggagatcgccagccgcagcttgacatcaaggctgatccgctccgttccgaagctggctgtaaaggcgatgacacccattgccgccgtaagcagaaacggtttggccacggctttgaagtaagccgacagccgcagcttaatgacatatgccagcagccagcgcccgatcaggaaattcaggatgctgatgaaagcgtacgtccaggctaccgtcaagagatttccggacagcacggcggcgtacaaagatgcgctatacagcagcatcaccccggcgtcccaataaaatgccagatcggcccgcccttttgccagcagcacagatccgttcggattcatcagaacccttaaaatcccgacgatggcgagaacatttaaaaccgggacagccgccagccatttttctccgaaaaccgaagccacgaatgcatccgatactgaaaccaaaccgagcaagagcggaaaggatatcagcgcgagtattttggtcatattgagaaacccttctctgatcacgctgttttcatgcttgtttttcgcaaagacgggaaacgcgactctcgtaatgatcggattgatttttaataccggaagcgtgacaatctggtaggccagattgtaaatgccgagcgcctcggcgccgataaaactgccgatcagaatcatatcaatattcgccccgagccggttcacaagccgggaagacagctgaaaggctccgaaagaaaagaagcctttcattcccttcagatcaaaaacgaacgccggtctccatgtttttctgcaggacacccagtacagaatgccttttgacgattgcagcagcacctgggaaatcacatacgcgagaatcgggtccgtataaaaaaccgcagccgtcaagtaaacgaaggacagcacatttgaaaagatttcaatcttgcttagcgtgttaaatgccagcgctttttgcagcatatactgatattgctgaccgatcggcgcgattaaaaacatgacggccagcacgcggattaaatagacaagctcctcccgccgataaaaatcggcaatgagcggactgctgaaaaacagcagcgcaaacagcgcaatccccgttatgatattcagccagtacaaggaagacatctgtttttcagtcacatgatctttttgaatgagcgcggcgccaaaacccatatcaagcgcaatttgggcaaacaccactaccgttgtgatcatgccgacaaggccgaattcagccagtgacatgacccgcccgagcagggcgaattggacaatttgaatgaccgtaatacacgctgtcgaaatacttgtccatttggcgccgctcaaaatttgatttgtaatactaggcatcgttttccctacttttttgtctgctgaccagaatttttatcgcgccccgtcaccggtccagatcactttgcacgttttgagcataatcttcagttccaatgaaaaggtcaggttgcggatataatataagtcaaacatcagtttttccctcggtgtcatgtcatatcccccgttgacctgcgcccagccgcttaatcccggcttaacggccagccgctccgtaaaccccggaatctcagcctgaaactgttccgtaaacacgggacgctcgggacgcgggccgatcaggctcatttctccccgaagcacatttaccagctgcggcagctcatcaatacgggtccttctgataaaagcgccgacctttgtcacgcggggatcctttttcagcgcccagaccgcccccgatttttcagcatctattttcatagagcggagcttatacaaataaaacggcttcccgtctttgcctacccgctcctgcttgtaaaaagccgggccgggcgactccaaacgaatcagtatggagaacaggcccatcaccgggagcgccgccaaaagccccgcaagcgcaaacacaatgtccatgaatcgcttaaaagccaaataacgggccgttctttccgtaacggcagcggaagtcccctgccgcactgcatagttattatttacattcatgcttttctctgctcccactgacacacacctcacgatttgttgggatgtttgatgacctatgccgtgagtttagcagatggatgttaattggaagtaaaggaaacgttaatgtttattagaatgtttcgattattgtttttttattgtaaatctattcatatccataaacggcggttactataattgaaaaggatcattatgagcggaaaacaacgaaaaagcctgccgatcaattttgaccagcaggctcgtacacaaatatataaaagttttacttataataagacacgattccatcattgatggctgcagctgccttttccttataggatgcttgctttaatttacttgcatcagacggattcgtaataaaagccgtctctactaatacactaggcattttggaatacttaatgacatagaacggagctgttttaacctctctgtctcttgtttttaatgcattaacaaccctaggctgaatttgtcctgccaggcgtttgcttgcagcggcttgatatgtctcatcatagtaggtctcagttccgtttgcagaagttgcatcatttgcattgccgtgaacgctgatgaataaatccgctcctgcggttgcacctttatttaccctttcctgcaaggaataaaatgtatcattagacctcgtcatgaccggcagagcacctgaagcatttaattttttattcagccttttagcgatatcaagattgacgtctttttctaaaatgccgttacctatagaaccggaatcttggcctccatgacccggatcaattaaaattgtttttcccgcggccggatttttcagctggtttgcaacatttgagctgacagccggggagttcccgataatggtaaagctgcttaatttttttcttccgatgatgactcttgtttcttttgaaagattgctgccgtttgtcagaatgatagattgttttttctttgcagcaagagcagcacccgctatggagtctgcatacccgaaaccattgctgacgaatacattgcctgtcggaagatttaattgctgaactagattggccgcaagttcgtatcgattgcttccgctgattctttttggtgaaggaagtttattgaagacagaggcatttatgctcccggttccccctgttacaatagagcttttgatccccttgctttttatagctcctgctgtcgcactgttgatatctgtttgattcgtaaacaaaattggatatccgttcattgcggcatatggaattgcagctattgcgtcagcatataaaaatccgtttgcaataacggcttttgaagcagcaggcatttcctttgctactttagctgccgtatcatatcggttgctccctgaaattctcttaacactgatgccgagcgctttgatttgatttgctgtatttgctgacacagcaggcgttccgccgacaataatgaccgtttttgtttttaattctttcagacgggttttcgtctctgatgacaaattatctttatttgtgtaaagcagcggcgcatttttctgatatgccatcggggcagcggatatagcatctgcatacgaacctccgccgacgacaacagccgtactcgctgttgaatacacctgcttggaaagcgcagcagccgtaccgtacctgttgcttccccctactcttttaaccgcgttgtcagctaaggctgacgggataaatatgatgagtcccagcatagaaatgatcaggactttaagataagaacgcaattgccttcctcctgctctcgtttatttaatagtcagtcaatgtggtgcccggataataaaattttaaaattgaactatatgaatctcctgaatccgctcttgccttagcgccgtattggctcattccgatgccgtgtccatatccctttccgctgattgtaaaagcagaaccgttttgactgacggtcacataagtgcttttaaacacggaggctccgatcattgttctcagttcagtaaccggcacagtcattgcagatgttttatttgcctcgtaatttccattgttttgtttgacagcgtaattcactttcaaagttgctgttttagcccgctgtcctttagttgttccgctgaatgtaaaatcttctaattttaaaattttaatggcggaagcgcccgtttccttatttttcaaaatccagtttttaataccgctcagttgagctgcatttgtctcattctttgaagcaaaccaagaggccggcttatttacatcaattgaatccggattgatttgctgcttagaaagcgtcagactccaggcagtttgaggatcttttgtgtcttttttcgcagttaaataaggaacgcttgaaccccatacttcgtcgcttgattctgtataaccgccattactcgatgaataagctgccgtaattaaattccctttgtaagtcagcaccttattttttgtctgctgcaccgctttcgtcgtattggcattccagctgtacccgccatatacttgaaaagcagtagtatcagcaacagtgctcccggtcttcgtaattgagtatgttcttgccgcaaccgtttgcgccttcagcgcttcaagagaccagcttgcaggcatttcattcggtacgacaccttttaaataatcttcaaaaggaatgttttcatttacaggtctgatatatttgcctgactctattgaaaaattaaccgtccccaagtattcttttccattcaaactgatccggttggattcattgtacgtttccggttttattctcaatgaattcccatatgttttaatatgattaagatttaactttccattattgatttgtaagttgtatgtgcttccgccggctaagtaaaaatggtttgaaagctcattttcaaccccggcggaaatggagcttgtacttccgataaagtcgtatgcatacgacgccttctcttttgtcactgatttagctgctgaaggaacatcatcttgtttgatatataataattggctgttttttttggcggctaaagaagcgcccaccaggacatcagcatatttcgttccattagtcatgacgactttatcagccttcaactttagctgattaataatattagcagtcaattcataccgtgttgatccgggtattcgctgcacagttgaagtttttttaatttgattttctacagcatcactcacgctgaacgaactcccgataattaagacttgcttcggaagatcataatctggcaatttatccttttcagtcagtaaaatgggatagccgtttgcagcggcatacggagcaatggctaaagcgtcttgaaaaacattccctgttacaacaattgctttatcgtaatttcccatttgttttgcaatgttttcagacagaacataacggtttttcccgctgattcttttcacagctccataagacttaagcttattttcaacgtcctttgaaatgcttttagccccgccgataaccagaatattatcgggattgaacttagcaatctgtttttctgtagtttttgtcaaagtgtccggctgtgtaaataacaccggcgcatccattttttttgccagaggaattactggtaatgcgtcgataaaaacatcacgattgacgagaataacggttttaggatttctccattgggagtcagatgcaagagccgcagtctcatatcgggatgcccccgaaaagcggttggttacagacacatgatcaccggtaacctgataaaaaccggttggcgataaagaaatgcttgattgatttccgatgtaatttgtcagcttaactgaaatatttgaatctgccgcaaaggaaaccgccggtataagcaatataacaacagctagagtcagtcctattaaatgtttgcaagttttcaagattacagcgtccccctattcattaatttgccggttcgatatccttcagcataagctgtcccttgctatttttttgatattttactgtcactttgtcgccattatccaaattcttaacatcgccggctgattcttcagtgatatcaaaacttaccggttcatgatccacagtgacttctattgtatgagtatccgccagtcctacataagtgccctctttcgtgaccagcttttcacccgcatcctcgccctgagatttttcattgttaactccgcacccggcgagaagcagtataaagaacaaacatccaaaaatttttttcatttttttcacctcattatggattatcgacaatatattatctattttaaagaaaaattaagaaacattgaaacttttttcgataacattcgactatattaggatttattgtattctattataaaatattgcatttgctgggagtccgatttccaattaaaacagatggggtgtattgagatgagaagtaaacgaagaaaaaagaaaaagactttgttactggtctttctgacaatcatcggcatttttattttagtttccggcggctttacatactatctatggcataaagcggcatcaaccgtcgccagcattcacgaagacattaacaaatcgaataaacgcagtactgaggtgaaaataaataaacacgaaccgttctctgtcttgatcatgggagtggacgaacgtaaaaatgataaaggaagagccgactcgctcatttaccttactgtcaatccaaagacaaaaacaacggaaatggtcagtattccgcgtgacacttatacaaaaattatcggcaaaggcacgatggataaaatcaatcattcatatgcatttggcggtacgcaaatggcagtagatactgtggagaatttcttgaacctgcctgtagattatttcattaaagtaaacatggaaagttttaaagatgtcgttgacactttaggaggcatcactgtcaacagtacattcgcttttaactatgacggttattccttcagcaaaggcaatatttcattaaacggtgatgaagccctcgcttactcacgaatgagaaaagaagatcctaaaggggatttcggccgccaggacagacagcggcagattatagagggtattatcaataaaggggcaagtatctcttctgtcacgaaattcggagatatgtttaaagtagtagagaacaatgtaaaaacgaatttaacctttgatgatatgtgggatattcaatccggttataaagatgcccgcaagaaagtgattcagcatgagctaaagggtgacggcaccaaaatcgacggaatttactattataaagcagatgaaaacggacttgcctccattactaaagaattgagaagcagcctcaacctttaaactaatgcagaaaaagcagcttcgcatactttatgcagagctgcttttttgttacacctcgaaagaatcaggacgctctgaacgcagtccgaattgatagagcagcccctcagcaatccttcttgacgccatgccatctccatagggattagatgcccgcgacattttttcatattccagcttgtctgtcagcagctgttttgccatctgataaatcgtttcttcatcagtaccggctaatttcagagtgcccgcctccactccttcaggccgttcagtagtatcgcgcaatacgagaaccggctttcctaaggaaggagcttcctcctgaacgcctcctgaatcagtcaaaataaaatacgaccttgacgcaaaattgtggaaatcaatcacttcaagaggttcaattaaatggacgcgctccgaatcaccaaagtgcttatcagcagcttcacgtacagcaggattcaggtgtaccggataaacgacttgcacatcgctgaattcatctgcgatccggcggatggctttaaacatatgttccatcggctgacctaaattttcccggcgatgcgccgtcagtaaaatcattctgtcattgccgattttctcaataatgttatgggaatattcagagtgaaccgttgtatgcaaagcatcaatcgctgtatttccggtaacaaaaatggagctttcttttttattctcattcaataaattttgcttcgcttgctgagtcggagcaaagtggatatcagcaagcgctccggtcatttggcggttcaattcttccggaaaaggtgaatatttgttgcccgtccgcaatccggcctccacgtgtccgactgtaatctggtgatagaaagctgcaaggcttccggcaaaggttgttgtcgtgtcaccatgaacaagaacaatatcaggtttgatttccttaaacaggccgtccagttttaccagggcgtttgaagtaatttcagccagcgtctgccgttctttcataatattcaaatcaaagtcaggcttaatttgaaatgcgtgaagaacttgatccagcatttgtctatgctgggcagttacagtgacatatgattctatttcagggcgtttttttaattcgagcacaaggggcgccatttttatcgcttcaggccttgtaccgaataccgtcatgactttaagttttttcatatctctttctcctgtatcaagtttgtgatcatttttcattatcaacccattttacacgatatgatccaccggttaaatatcttgtattatttttcccctaaatgaaaaaggatatatcattaaggctttacggataaaacttgtttaataatggtttatcttatatcattaaaagtgttaaaaatgaaatatcgggtatacagaaaatatcagcaagcctgagtctgtatagatatcataacttatatttaagtgacgctaaggaaggtgctttaaagtgaaaaaagtacgcaaagccataattcccgctgcaggtttagggacacgctttctgccggcaacaaaagccatgccgaaagagatgcttccgattgtagacaaaccaacgattcaatacataattgaagaagcggttgaagcgggtattgaagacattattattgttacgggaaaaagcaagagagccattgaagaccattttgattactcaccagagctggaaagaaatctagaagaaaaagggaaggtcgaactcttagaaaaagtccgaaaagcctctaatcttgctgacattcattatatccggcaaaaggagccaaaaggtcttggacatgccgtttggtgcgcacgtaattttatcggtgacgagccatttgccgtccttctcggagatgatatcgttcaagctgaaaaaccagggcttcgccagctgatggatgaatatgaaaaaacactttcttctattataggggttcagcaagtgcctgaagaagaaacccatcgttacggaattattgatccgctgacaagtgaaggccgcagatatcaggtgaagaactttgttgagaagccggctcaagggactgctccgtccaatctggcaatactgggacgttacgtcttcactcctgaaatcttcatgtatcttgaggaacagcaaattggtgccggaggggaaattcagcttacagacgctattcaaaagctaaatgaaattcagcgggtttttgcttacgattttgagggcaaaagatatgatgttggtgaaaaactaggttttattaccactacattagaatttgcgatgcaggatcgtgaactgcgtgatcaccttatccctttcatggaagacctgttaagaaaagatgaattataagaaaaaagctgttggatttattccaacagctttttattttaaaatgcaggttaaagtttgattatcgttattgataataaaagcgtatttatcatttgccgcaataaattgccgatcactgctggcctttataacacctttattattcagggatagatctgccggagtaatagctgatattcctctgaaaacaagctgctcggtcttgccattattcactacataactgacctcgccatttttaagatatagcgtctcccggccgttcaccacttctttctgcagctctttcatttcttgctggatatcattaacgcgctcaccgagatgcgacacaagttgatcagcatcaccctgctttacatacggagaaaaagcggatgctttcacatttgaatttttttcgttatagaccgctgcgttttccgggatatagtacgttttattgttgacctcgatctttgctgattgcctgtcttcagataccactttcacctgagcaccgaacggaataaggaagtccgccttttttttcagctctgtatctttataggcctgcgtctggtcttttaatacgaaaccttttttgttcaccaatatctggtctttccccttgttaacatcatcttgatatccgatcttaccgaacgatgcgatcgtacgaagcggggcgctgaaaaacatggttccggccataaacacaagcagtattgataaaatagcaatttgaatagcattgactgctgatccggatttattttttttcttttgttccttcacaattgcctgctgctcaggcgattcttttttacgttcagcaacctgatctttcttatatttctctttgtcttttttggagagcttattaaaccaatcgataaatgctttgtactctttgactacggttttagtatcgtcgaacattcttaattcaccatagtgcatccaagccacacggtcacacattttttcaatctgaccgatggaatgactcacaaagaaaatggtttttcctcgttctttaaattcctggattcggtcgacacatttctgataaaatgtctgatccccgacagagagggcttcatcaatgattaaaatatccggatctatatgcacggatatcgcaaagccgaggcgggacttcataccgctagaatagttttttaccggctgattaataaaatcaccaatctcagcaaactcaactatgctttcatacatctcatcgatttctttattggtcagccccatcattaaacatttgagtctaatgttatcccggcccgtcaaagcattatttaaaccggctgcaatcgcgatcagcgacggctggccgttcatttcaatttcaccgcttgtcggcggtattacttttgcaagcagatttgacatcgtcgatttacccgatccgttaattcctacaaagccgattgtctccccttcatatacatcaaaggagacatttcgcacagcgaaaaaaccgttatctttagcagggaaaaacaaaccttttattttgtccgactgtttttcataaagatgatactgctttgaaacatttcgaaacgaaacctttagtttcattgtacaatctccttacgtattaaagaaagtcaataaacttatctctgaatttcatgtgtaaaacagaaccgactgttaataaaaataaggtgaacagccagaaatacagtgtatacttcacatcttgaaagaaccactggccatctaagaaactgttcctgaatccgtcaataatatagaacagcggattcagcttcaggaccggcaccaattccgggtgatctgcccccagtttcgagtgaatgtcccaaaaaatcggcagcaggaaaaataaaagtcttgtcactgcctgcagaagaaactgatagtctcggatcagcacgctgattgtcgaattaaacaagctgaacgaaaataagaaagccatcagacaaacaaaataataaatatattgaagccaatgaaggctcggatagattccgctggcgagcaatgcaatgatatagatcaccatcataattgcataactgaacaaattagaagcgatggcgacagacggcaaagaactgattgggaaattcattttagcaaccattttaattcttttaaatacactatttgatccgtccagtattgtcgggcttataaaaaaccacggtatcagacctgcaagcatccacagaataaaaggcacttctccggcacctgtagccatcggccccccttttctgatccccaatccaaaaacaaaccaataggcgagcatttgaataagaggatttaaaaactgccataaaacgcctaaataattcatttgatatttagactttgtttcgtaggccgctaatcgcatgattaaaggaaatgatgttacttgctcttttagtattttcactacagcattcattttaatcttccttaggttgatttgattttataaagcatcgctgataattgtaccagaaatcaaattttttttcactttcaagccgcatgcaaatgctgctaaaaagtttgtaaagcgtaatagaaaaaccccttgatacaaaggggtttttctattattcagattcaaacacaatctttacgactttctcagaagaatgtcctgactcaagataacagaatttgtcataaaaaggtttgaatgaaaccgggtgctgataatccggtgatgaaatatgtttgattgcctcgatcgtttcctctgtcgttttcactaacggaccaggagcatctttctcaaaatcgaaataaaaccctctgagtttatcccggtatgtttcaatatcgggaacaaaaaacaacatcgggcgtttcagatttgcaaaatcgaaaaatacagaagagtaatcggtgattaacagatctgaaatcatatacaattcccgaatatcttcgtgtgcagaaaagtcgtaagcaaacccttcaaatggaccaaggtcaaaattttcggccacaagataatgcattctcagaataacgagatattcatctccgagctcttcccttaatttatgcaggtctaaatcaaggtcaaatttataacggcctttagcataaaactggtcatctctccatgtcggcgcataaagaataattttcttatcctcaggcaggtttaatcttcttttgatcgctgtgattgtctcattattattgtcattatgaagaaaatcatttctcggataacctgattcaatcatggttttatcgaattggaaggcgcgcgcaaatatctcagacgagtaggcattaggggaaattaaataatcccaattggatgcctctttaataaaattctttttatattttttcgtattagtacccggcatatgaacttcttccatatccattgcaagtctttttaaaggcgtgccgtgccatgtttgaagataggttgtatgttcaggctttggaatccataaaggcagacggctgttgacgacccaatattctgcccgcgccatagcaaacagccacttgatagaaagcctgttaatgtattgaatgcccttctctttaaaaggcgctgcatactgtttatttacgctccaatacattttatattccgggtgattgatttgcatgtattcataaattgctctcggattacagctgtattgtttgccgttaaagctttcaaaaataatggtcttgcttttaacaggcattttactcgccattctgaaaacaactttataacctttcgtaataagggaatttctgcgttttttcagttttttcattttggaaatgaaacgttttttcttcccttttatgaagtatctcatccttgttttcaggctgtagtcgttcacacggatacagacagtctgctttttcttctttttatatacttcatatctgaccggcccgctgtctttattcacaacgcttatgaggcctttcagtttattttttctgtctccgagcacaagcggagtgctgctgagaacaataggttcagcttcgtcgttttcacaatgaaactccataaacatacggtagacaaaccgtttttccagagaataaggaatatcttttaatggaatttttatttggaaatcaaaaatttcaggggtgaatgcatcttcccgaagctgttcaatattctccgtttttttcgtcacttcaatagggaaatgtttttctacggggtcttctcccccttttttaatgacaaattgcaggtttttaactgaaagctgattctccgaacttagatatcctgcataccctgaaatcataatctcttctgccttcagctgaatctcatcaaacttcacaattttcgcttctctttttacctttaaggaaaaattccccttatcggttgtataaggcaaaattaacagctcagtcgtatgatcaaggtggtaggcacgctcaatcgcttcagcttccacagataaacgcacctgcttcggctgttcttcttcttcagcttccggttcaccaagtaccacataaaaatcataagtctgtcccatttctaaaggttcaggaaacgagtgaatattaattgatgcgctgtactgagccgggctctctttctctaaaacaataaagtcctcggctccggaacgccgttcttttaattttaaataacatttcacttcctcagctaacggttcttcgctttcaagtgaaatagagagcgccagatcgcccacattattttttaagcttttcaaaatacatttactcacagtattttcatccatacttattttctgctcctctgtattaaagctcttcactttgccgatttacttaatcgatgtgatcctttttgtttaatttaatagagaaattccctttcacagtcgtataaggttcgaaagtgtatccgttcttcataaaccgttccttttcgccgaaaataacttcacggctggatacccttctaagaatactgatatggtcagctgttacaaactgaatgtaaaagtcaagaaccgaagtaagattagcatcgattttttcttttttgatatccttttcaaaatcaatagtaaacggctgagccggttgatcagcggatacggagatgatttcagctttgttttttcgatcaatcccgaccagtctgactttttcaaagccatcattctgattgcacactgaaacgctgatcgtcaatccggtgccgctattttcaaaggatgtaatcggctgttctttagaaccgactttttcagcgagccgttccttttcttttctcacttcaatcattttggaaagagcatatgaccaatttttaatataatttggttttgagtatttctcagccattttaaaggccttacgtgaaaattgttgatgagtgctgtcatctctcattaaagagacaatggcctcggctaatttttctatattatattgctcgattacatagccgtttactccgtcttctaccaagcttctggcaccgtaatcataatcgtaagttaccacagggcatccattgctcaatgcttccatgttggacagaccgaagccttcaaagtgagacgttgaaattgtcagccacgctttttgaaactcgtaatcggggttattcgtgtagcctttcagcaatacattattctggaggttttgagcttcaatttcctttttgattttttctgtatcttctccagacccgaatatttccaatttcgcatccgggatttcatttacaacaagtttgaacgctttaacggcatgcgtcaggtttttcatcgcggcaagccttgagataataaccgctttatttcgttcactcggaacgttcagtaccttttcatcaagcggtttattaatggtatgcggcgtaaaaaagaaagtctctttttcccctgtaattaaagtgaaatctgcaatctgctcctcagtaataaaaaatacagcatccagattattgatctggccaaaaacttctttataacgccctttgatctggaatttattatcaccataatgtttattgtgaataatcgcggcataatatgatgacggcgcttttttcactctgaagacatgtttgtcctgaggtctgctgtctaccagaaatagtttaggctgatcgttttcattttgaagaacgtctatccaataccggcgcagctcagattcatctttaaatgttaatggaccttcctctgtgtaccacgtgaaatgggtaaatttcacttcttcactttggctgtcccacatgtagtgtttttccaggtaaacgacactttcgctgttgataaactcctgaaggaagatttggttaatctttgtgtcaaaatgagagacaatgacgggttttccttctttattgtattcttctcttttgattacttgtttttcatcattcagatagtctacgtaacgcaccgccgaaccgcctgaataataggaaagaatataatcatttgatgatttgccgaagatctttgaaattgccttgcttactttccccttgctgacatgtctttttatttgatccagctcaattttctccgaataaatccgcttgccttttgtttttttacttaaaaagtcatcatacatgtttataacttgagtgtattcagagtcagcttttcccttttcaaacagctcgttcttttttctagcaaactctaaatctaatctaaaagtaagaaaggtggtattcttttggctttcttctccgaatagtttagaacgcaataatagtgatttggtcagaccgccgtaattatccggcagtccgcctgagataaaataatacatcatatcgggaagctcattattatagttaataggctgattggacaaattttttctccctttcaccatatgaatttagtagaacactgcaaaataatactattcccgcagattaaaatagcaaaaccaatttaagcatcaaaaagtacttcttatcaataaataagaagtactttgatggtttttcactcaatctattatatttccgtattacaccccggcaatttcttttttaatctgtgtggtggaaatgccttcggttctagggagatagatgacttcgcattgatctttaaggaaatcgaatttgccttcccaatcgtctcccattacgaacacgtcgatgttgtgatccgctacgtcacgtactttttgatcccagctgttttccggaatgacttcgtcgacataacggatcgtttccagaatcagctttctgtgttcatagctgtggtaggcctttttttgtttttgcaggttgaactcgtctgttgagatggcaacaactaggtaatctccaagctgctttgcgcgctcaagcagtttaatatgaccccaatgcagtaaatcaaacgttccgtaagtaatgaccttcttcatgaaacaaaagctcctttctatcatcatacgtataacaagcaactgccctgaaatgctgcgcagctgtatccttaatcactaaagtgccaatttcgtactcatggaacctcattatatcacatagccctgaaaaggttaagccaatgtaaaacgaagttaaattccacttattaacaaatgttattacaataggagtttagcagggtttttgcgcggttgattaaagaaattgttatcttatttatatttttgtaaaactattgttaagtttatctgaaggtattatgttaaaataaagcttagcctaagtcacgaaaaaatgaaagaaaatcccgtacaaaaaggaggacggcagatgcagactgaaatggtgcacaacctttcttatgttaatggaaatttacaggagtttatttcatatttagacacttattatatcgcacaaaagcaaggagccgtcattgcgacggtcaaccctgagatcggatacgctgctgcgaaagacaaaggttatcatcaagtcatttcttccgcggatttcgtcctgccggatggtatcggcgtcgtgttaatgtcacgtttgacgcagcacccgctgaaatcaagaattgcgggattcgatgtatttctgtcgctgcttggtctcgcaaaccggcagtctaaaaaaatatttttatacggagctaagcaagacgtgcttgacgccgttttggaccggatcggcaaagagtatccgaatattgaggttgtcggagccagcaacggttatgaagcggataaacgcttcgtcgccaaacagatttcccgggcgaaacccgatctcgtgtttgtcgccttaggatatccccatcaggaacaatttatttatgaatacaaacatcttttccctcaggctgtatcgatcggtttgggcggaagctttgatgtgttcagcggaacggtgaaacgcgcccctgaatggatgatcaaaacgaatctggaatggctgtacagactggtgacgaatccgtggagatggaaaaggatgctgaacattccgaagtatgcttttaccgttttgagaaataataaatcaaataaaagcctgtattccaagcaggcagaagatcaaacgaaacagctttaaacaaataaaacagcaaaagagattggtaatctatgaacttgcgatctttattcgccgctttttattctatatatctgtctgttctgggcgttttgttcaagcctgtaaagcccaagaaccatctgaccctgctggtatcttttgaagagaatgcacaggctctcatccgctcttacaaagcgcacgctgaatcgctttcttatgaaatgacggttttgtatacgagacacgccgtcagtctgaaaaaagagctggaaggtctcggctctttttatctgaacgaaaaacatccgctgcatcttttgaaggcagttttgatcctttttaagagcaaagcggtgataacggataactatttcctcatgacaagcgtcttaaaccgccggccgcaaacgacatgcattcaggtgtggcatgcgaacggctctttgaaaaagttcggccttgaggatgtgacgaatcaaaaccgtccggcatcagacatcagccgttttaaaaaagtgtaccgctcgtttgactttgtcaccgtcggttcagacgcgatggctgacgtttttaaaaagtcgttcggcatacgggacggccagctgttaaaaacgggtgtccccctgactgacgtgtattatgaagaacacaagcccgaactgaagcacaaatggccgaaaaaaatcatcctgtacgcaccgacattcagggattatgatatgcagtcctttcggctgccattcaccgaagaacagctcacaaacgcgttaaacggagagtatatgctgcttgtaaagcttcatcctgccgttttgcatcatatttcggcttcgtttgaaagcgaattgatcaagaacgtgtctgacatgcgtcttcatgatctcttgaaagcggctgatattttaattacggattactcttccgtgccttttgaattcgcgctcttaaataaaccgattttctttttcacgtatgatctggaggaatatgatcgaaaacgcggtttaatcgacaattatacttccgtcattcccggaaaagcttgtcatgacagcgaagctcttctggaggaaatgacgaaaaagccatttcgtgcagaagaaatgaagcggttctcggacaaatggaatatgtattcagatgggaattcgagtgaagcgttattaaaatttgcggaaacaaaaatgaaaaattgcgctgaagcacctgcctgaatctgaggcgggtgttttttgcatgaagaaagggctgaagcatgcacttcagccctttttttatactttcatatacacgggaacatcatagtaaagcgtatagtcatccagcagtgagtataagctgtacatgcggtttacctgcttatacgcccagccgatgtctgtcgcatactgatgagccgcggctggagaccatctcattttatacagcgtatcctgctcgtatgaaggattgtgaatataagacgcaccgataaattgggctccgccgataatcgcggcttccggagtaaaccagccttgcttatacgcgtattgtgcgccgtagtaattcgggttgctgtcataagccccgatgccgtacatgttgtaaacctttttaccattatacataatgccgttcgcaagctctgacgtgccattgcccgtttcaagcaaagcatgcgaaatcaaatacacttcattgatgctgtatttgccggcggctgtaataaaggcctggccttttcctgtcagtattcctttattgaccagcactttttgattcagttccgatgcgttcagtccggctgtctgagagagcttcagaaattgaaagtaatacttgctgtcttgtgcgaagtgagccggattgacgtactgcccgacttcgtcactgctggcgtttctccagcccatactgagtttggcccagccgtttgtctggcctgtgatgctgactttatcgccttttttcaactgcccgataatattgccggagctgacttccggggttgaccggacgttcaggacgtcggctgtgaccgttccggaggccgtattgatgtacgtaagcgatgcataagccgcggcatcagtctgcgggctgactgtcatttgttttttgaccatatctgccagcgagatgttgtaattggtattcatgatttgcggtccgttttttattttcagaatagccatcgtccatccgtacagctttttcagcttttgggaggcggcgtccgctgactgcgctcccgtgaattgatcgcgaatgcggagttcataaaccggatggctttcactcgtatagccggcctgtaattgtttggcgctgaaaaagctcatgcttttatttaaaacggttttactgctgaatttttcggttttgatgacgtactgtgcggagccggttttccccgtctccttcacagtgccggccgctttgttttgcttgaaaaaagcagtcacgcggtcaatgtcttccttcttaagcagcggtgccgtttcaattctgaattgtgtatacgccgcttcacctgttttctgtgcggaggcggatacttttttccctttaaaaaaatccagcgattgattgatctttgccgtatcaagcagtgattcggttgtgacttggtacgttgtgtccgtctgcttggatatcgtttttgaaatggcagtcagtttatatcccgccagcagattcaatcctttttttatcttcgactggtctgccgtctgctgagaaagcagctgatattcgttttctgctgtttttcccgccgctgttcttgccgtctttacatgctgctggcggaaaaacgcctccgtttgttctgcctttgcagcggtaagctgccctgccgtgatccggtaaacggacactgatgctgtctttttgacaggcgatgcgtcgcaatgccattttttctttttaaagaaagcttgcacgctttgcagctgtttagccgtcagtccgctcatcgcgaccgtgtaattattcttcttgccggctttttgatagcttccgctgacacccgtattcttcttgatttgggtgatagcattttgtacggcgcttactccgttaaaatatcctgactgcacgttatacacggttgctgttttgctttgggcatacttttgaacgttccctttgacgcctgttttctgctgcagctgtttcgctaaacctgccgcatcagttgcatttgaaatgccagaggctgtcacggtgatattcggactggcctttgccgtgactttcagcgacgactgcaatcctgtttccttttgaaaatcagtttgaatttgagcggctttttgatcgccggagattgttcccgattggatctgaaaccgggctgtttcccgtttgatctgacggtatgacgctttcacgcccgtctgcttcgtcaacgcttgcgagagcgcttttgcatccgcatcggccgccatctcagaagtcacgacctgcatatacggctgttttgtccccgccggcttgacggcgccggtcacgcccgtttttttcgtcagttcggcaagaagatttttcgtctgccgctcgtctgatagaacgcctgatgtgacggtcacgtacggctgtttgcttccgcttgcgctgtaagtgccggccacgcccgtctgcttcgtaaagtctttcagcacggttttcgcatccgtttcatcgtgtaagcctgaagctgagatttgataagtgagcggcgcatttccggctttctttgcgtcagcctgccaccccgtatcctttttcaatttcgctgccgcttgaagcgcctcgttctcagaagcaaattgctgcttcgtttccagctcgtaaacggagtagtcgctgtatgcggcctcggcgtgctgtgtaacggtgctaaagacaaggaaaacggcggacaataacataggtgcaacaaatctctttttcattccttctcctctttctgattcaattggtttctatcaaactagtttatttatcggcccgctttcttcatttttacagagagaaatcatccaattatccaaataaaaaaaacttaatcccagagctgggattaagtttggttttatatatgagaaacgatgatcgtgcaatctccgtttatcgtaaagtcaggcatctgatccggcagtatgaaatgcgcgcctttttcaagcttggcggacttgccttcaaagatgatggagccgcttccttctgtgacgctgcacagcataaacggagcgtcctgggtcatttccgccgtcccgctgatatcccatttgtatacagaaaaatattctccctgcacaaaggttttaatggtgatgccttttctcgtttcagttgattcatccaaaaatccgtccacatgaggaacggtggcggcgttgacggcatcgcggatatgcagctcacgcgccccgccgttttgatctgtacgcccgtaatcatatatccggtaggcggcgtctgaattctgctgtatttccagcacgagcgccccggcgcaaatggcatggatggttccgctcggcacataataaaaatcgccgggtttaatcttcacgcggcgcagcaggccttcccagtcaccgctgttaatcatggtgacaagttccgctttcgaacgggccgtatgaccatatacgatttccgcattttctttacagtcaataatgtaccagcactcagatttccccgtttcgccctgtccatgctcctcggcgtcataatcgtcaggatggactttaacggacagatgatgtttggcgtccagtattttcgtcagcagcggaaaccggtccccttccgttccgccgaataactctctatgctgatcccacaggtccatcaaggttttcccttgatacggaccgcttttgaccgtgctcattccgtgcggatgggctgatatcgcccagcattcgccggttgtttctgaaggtatgtcatatccgaatcgttcgcgtaataacgtgccgccccatattttttctttacatacaggctgtagaaaaatcggctcttgcgtcatgttcgttcccctccccttaaaaagcggctcatatcccattccccctgtgtcttttttaaaacacggagggagccgcggttaaaaacaatatgtataaaatggctgacctgctcattataccattcggatggggcggaatgctcagtcatttcctattccagaataaaatgccttgtttgtcgcaaattaaaataactgatggaaaggggggaacattatgacgatacatgcggagctcggcaaaaaccttgaagcgctgaaaaaacggatcggccaaagcgatgacatgatgttttattcgtttacgtacggaaacggcaaatgtgacgcctgccttatatatatagacggactgaccgacaatcaattgcttgcggaatatattatttcgcccgtgcaggcggccgccctgcatcaagaggaaccggctgaaataccgccgtcatccatctctttcggctatcgtcacacccggctttcttcacttaaggacgcggaggcagacattttttccggcaaatcggttttgctggcggagggatgggaggaagccctttcgtttgaaacggaaacatttaaaatgcgtgatattgaagaaccggcttcagaagtgcttgaacgggggcctaggataggttttgtcgaaaagctccgaacgaacacggcgcttttgcgcgagcagtccggtgatcccaacctccagatcaaagagatcacactcggcgaacggacaaaaaagcggatcgccgttgcctacattcgggatattgcgcctgatgaggttgtaaaagaagtgatgaaaagactggattcgatcaccattgatgacattccggaatcaggaacgatcgagcagcttattgaagataacacgtattccattttcccgaccgtcttgacgaccgaacggcccgaccgggttatgggcgctcttttggaaggaagggtctccattcttgtagacggaacgccttttacccttttggtgccggctaccattgatgaatttatccactcacctgacgattataatcagcggtgggttccggttaactttctcagactgcttcggtatacatgcattttaatcacgatttatttacccggcctttacatatcgctcgttacgtttcacacggggcttttgccgacgagaatggcggtgacgattgccggaagcagattgaatgttccgtttcccccttttgttgaagcgtttattatgatttttacgattgagatgatcagagaagccggactcaggctgccgaagccgatcggacagacgatcggcctgatcgggggcgtggtgatcgggcaggccgccgttcaggcgaacatcgtcagcgcgatgatggtcattatcgtatccgttacggcattggcttcttttacggcgccctcctatgcgttcaattttccgctgagactcatccgtattttttcgatgattttgtcggcgatattaggtttatacggactgatcatgtgttatctgcttgtcgtcggccatctgatgcgcctgaaaagcttcggccaggactatcttattccgatcatggcgcagccgggacaggacttaaaagatacgatcgtcagactgccgacgcctcttttgaaaaaacggccgaccagaaaagagacgaaagataaaatcaagcaaaggtgatcaccatgaaaaaaccggaagacaagctgtcgtttatgcagacacttctcatggtaagcggaacaatgatcggagcgggcgtgttaacactgccgcgctccgccgcagcagcggacagtccgagcggatggatcattattcttgtgcagagtctcgtgtttatcggcatcgtcctgctctttatgccgtttttgcagaaaaacagcggggaaaccatttatgagctgaatcaaagcatcatgggacgcgccatcggttctcttctgaatttattcatcagctgttattttgtcgtcaccgtctgttttcaagcccgttttctcggtgaggtcatcaattactttttactgaaaaatacgccgatgggtgtcgttatattcatctttctggcggtcggcatctaccatgtgaccggcggggtctatcccatttcaaaactctatgcttatctctttccgattgcgatcgtcattctgattgtgctgctcatattcagcctgagactgtttaagctggatttcgtccgcccggtcttggatgggggctacaaaagcttttttgagctgtttccgcggacccttctgtacttttcaggacttgaggtgattctttatctggtgccgtttatgaaaaatccgaagcaggcgaaaaaggctgccgtcttcggcatcgcatgcgcaggcttattttacagctttacgctgcttgtcgtaatcggctgtatgtcgatcgctgaagccaaaacggtgacatatccgaccatttccctgattcacgccttggaaatccgcggtattttcatcgaaaggtttgatatctttcttttaattacgtggacatgccagcagttcacctgtatgctcggttcttttaaaggagcgcatctcggattaaacaccattttcaaactgaaaaataaaaacaatgcctggctgctggggggcttattggcagtgacattcggcctttcaatgtaccccgatgatatcaacagtgtgtttgcatttgcgaatattctcggatatgcgttttttgccgtcattatgattccttttctcatctggtttgtcagctggatgaaaaaaatagccgggaggaaacagacgtcatgacacatttcgtaaaatgggcggcggcgcttttcatactgatgacgctttcagggtgctgggacgcgaaggaagttgaaaagctgtctttcgcccgggggctggcgatagacgagacgagtgaccgccgatataaattaacctatcaaaacctgctgccccaaagtgaaaacagccaggcttccggccggcccgtgtttgtcaatgtgacgtcgcgggggataccattcttgaagccgtcagtgaagtcgctttaaaagatccgcccgtttacagcgatcatttaaaagtgctgatattcagcgacaaattgctggccgaccaaaatatactccagatgatgaatcattttatccgcgatgatgaattaaggcggagcagctatctcttcgcggcaagaggtaaagcgtccgatattctgacggagccgacgccgaatcagcagcagcccatgcctgcggaaaagctgatcgaccttacgaacaacggcggctacaacgggaagattttaaaaccgctccgaatcgggagagcttcgatttactgccataataaactcagttttctcattcaggccgtcagcaatcaaaaaggaaaaacggtgtatgacggagcggccattatcaaaaacgcaaaacaaaacagattggcgggctttctgtcatcatacgaagtacagagcctgaattggctgacggggacgatacggggcggcgtgctgcccgctttggataaaggggggcacccgattaccttcgaaatcaaaaaatcaacatcctccatcacccccctgctgaaaaacgggaagctgtcatttcatgtagcggtgaaaacaaaaggacttttgtcagaggatcaatatgccggagaagattcattcgatcagcactatttaaacgggctggaaaagattttcgaaaaaaaactgaaaagcgatatgaaagaagtcatcgataagctgcagaatcaatatgaaacggaccctgtcttcttttctgacagagtccgcattcaatatcccgactattggaagaaagtaaagcaccgctgggatgagaccttctccgaagcggcctttgactatgatgtttccattcagattaccaacttcggaacgatgggacggtagccttcagcgttttttttcgacacgaaggagaatctgataaatccggctttgttcgggcagctgtgtcaccggaaattgcatcgattgcgccattcgtgtgatttcctgtaaaaacagctgcacacgctcatccacgtgaacatacgtataggactgctttttcacgtcaaatgtctcttccggaaagagcgtgcgcaccgtctgcggcgtaaaaaaccgcaagtgggtgcggtcgagaataccggcgtctctgtatgtccagtcaccgagcagaagcgggaacagcgcttcggcgtgggaaatattcggaatgctgcaaacgattgatccggcaggcgacaaataggatgagtacgtttcaatgacgcgccacgggtcttttaagtgctcaaggatgtccgcgaaaatgatgcaatcaaaaaagccttccggataaggcagcttcactttttcgacatcttcctgcagcaccgcttcatagtgtccttttgccgcttgcgccgccagcgggtgcagttctattccgtacagttcgcaaggctgtctgttttgaagttccagccccgtagctcccgcaccgcagccgacatcaagtatccgtttcgcctcccggggaacgagctccgcaatttccggtctcggatgagtaaagtacgtaaaatcagtgccccatttttccgtaaaacgctggcggttctccgaatataactgattgatattgatatcctgattagccgtaaacgtcgcatgcccgtggtgatgcacaaaggcatcgagagcgatgtgcaggctgtatcctttttgcagggcgcgcagacataggtcatcatcttcaaaagaaccgtatccgaattgctcatcaaacgggccgatgtcttcaatgacgctttttttcaccagaagacagaagccgacaaggcgcagcacccgctttgtttgatgcttttcccgtgcgcaatacgcctccgcgaatgactccagctcatcaagcgattgatacgtgtcatggatcatttgcgcgccgctgacatagttgctgacgggcccgaccataccggttttttcagattgatacagcaccctcagcatggaggtgagccaatttttcgtgaccatcgtatcgttgttcagaaacagcagattttctccccctgccgcttcgattccctggttgcaccccttggcgaacccgaggtttttttcattaaggatgactttgacgtcaggcagatttgatatgtattctctcgttccgtctgaggaaccgttgtcaactataatcagttcaatcttatctttgtcggtgtatcgttcaatgctggccagacattttttcgtcagctcaagttcattatatgtaaggataataatactcgttttcaccggcatccccgcctttatcgtgactttatacaacgtatgacatatccccgtcatttatgtgaccgtgcgggcgcccgcacgcatccgttttgaggggccggtgaataaccgcccccctaaaactgaatattacagatgaactgtccgccgatttgattctgatcccgagcctccgttacggcttttcagatcctgctcaatttcttcaaggcttttccccttcgtctcggtcactttaaaccggacgaacaggaatgccattattccgatagcggcataaatgagaaataaatagctgatgccgactgcttccattagcatcggataggttaatgagacaatcaatgttccggcatgcagcatcaaagtggagacacccgtcccgataccccggacatgcagcgggaataattcaggaagcatgacccacacggcaggcccccagctgaccgcaaacacaatgataaacaggcctaaacaaatcaccgttgtccatgatgcggctgctgaatgttcaaagaaaagattgaccgcggccaatacgagcagactgatgaccatgcccgcatttccggccagcagcagcggcttccggccgatcttatcaatgactttaatagccgcaagcgtcatgatgacattgacggcgccgattccgaccgttcccaatatagacgcggaattgccgaacccgacactggtaaatgttttcggtgcgtaataaataattgtatttgtcccgatgaattgctgcaaaaaggcaagtccgaggccggcaatcagcgcgggtctcacccacggctcaaacaattctttcaagccgccttcgttttccttttccgcttctttcatctgatcaatctcatcatcaatattcttcgttccccgcaatgatgaaaggatttctcttgctttctcttctttgccgatcgtaaacagccagcgcgggctttccggcataaataagattccgatcagcagaatgactgacggcacaaccgcaagtccaagcatccagcgccaagcgcctgcatcggcaaatatatagttcacgatataagaaacgaggattccgaccgtaatcatcagctgattcagcgaagaaagcgccccccgtttatgcttcggagccagctccgataaatagagcgggacgatcgttgtagatgttccgacagcaagtccgagaataatccggaaaagaaccatcacccctgtattcggggcaaaagcgactcctaaaccgcctatacaaaacagcagcgccgctcccatgatggccttccgcctgccgaaccggtcggtcagtttgccggcgaatcccgatccgagaatcgcccccgccaataacgaactgacgacgaggccttctgtaaaggcgttcaatcccagttcttttttcataaacaaaatagctccggaaatgactccggtatcatatccgtataacgcgcccccgagagcgccgaaaaaatagagccatttattcgagtgtatgcttttcatgttatatagactcccttcatccaacgctgtatccgcgcggaattgttctactgcttcttttgcctgtttccgatcgtttcaaaccttccgcaccgttaatatccattattttactgattatttttcacaaagcgacgaaacatttcccgcttcctgccgtccaatataatgtgaacctgatgcaaaaataacagtagatgttgtcgaaatagagagaaagatttagaattttctcatttgcagagttgctccgagtcaacaattatggtacgcttcacaaagaatagaaacgagaggtaatgatatggaagaacgatctcaacgcagaaaaaagaaaagacgcctcagaaaatgggtgaaatttgtactggtattcgccgctttcttattggtgatcgccggttccgtcggcacctacgcatttgtgaaattgaataatgcgaccaaagaagcgcacgtcagccttgaccgcggcgaccagtccgtaaaacggatcaaagaatttgacccgaagaaggattctttcaccgtattgcttttaggaatagacgcccgtgacaataagggtgaatcagtagatgacgcaagaagtgacgccaacgtgctcgtcaccttcaaccggaaaaagaaaacagcgacaatgctcagcattccgcgggattcctatgtcaacatcccgggacacggctatgacaaattcgcgcacgcacatgcttacggcggttataatttaacttataaaacagtagaaaacatgtttgatattccggtagattatgtggttgagagcaacttcgacgcgttccgcgatgtcgtcaatgagttgaacggcgttacggtaaatgtgaaaagccagaaaattgccgatcgtattaaagtcgatacaaaaggaaaagtcgtgctgaagccgggcgtccagacgcttgacggtgagcaggcactggcttatgtaagaacacgcaaagcggacaccgatctgatgcgcggacaaagacagatggaagtgctgagcgccattattaaaaaatctaaatcgttaagctcgatcccatcgtatgacgatatcgtcgacagcttagggaaaaacttgaaaatgaacttatctcttaatgacgccatcggtctgttcccgtttatcacatcgctgaaatcggtgaattctttgcagctgacaggttcagacagctacatttacactcctcagtacggcaaaaatatttattacttcaagctgaatgaggaaaaccttcaagaagtaaaaacgaaattaaaaaatgatttagacgcgtaagatgtcacggcgggattagcaaatcccgccgtttttctgttgaaaaaaaggacatgaaggtatagccttttaactgacggctttctgctgatttcgcacaaagctgaacatactacatgaagcagctttatttttaaggagggcatccatacatatgaaattgatagccattgacttagacggcacattactgaattcggacagtgtgatttctccggaaaacagagcggctttacaaagagcggatgaagcgggcattctcgtggccatctgcacgggcagagccacgtttgatgtaaaagcgctcttaaaggatttggatattccgatcattgcggcaaacggcgggacagtccatgacaaaggataccgcctcgtcagccgcctcttaatggatcagcaggccggaaaggatatcgccgcttatttaacgaacaaagacatttactttgaggtctatacagatgatcatctgctgtccccgtttgacggcgagtccaaactgcaggcagaactggacattctgaaaagcgccaatcccaaggaagatattcagacattatgggagggcgcaaagacgcagttcaaacaattcggcattaaacccgtacaggatatacaggcgatttttaacggagacgaacatgtttacaagcttctttgtttctcttttgatatggaaaaattgagaaacgccaaagaagaaattacacatcatccgaaattatcccagacatcttccggaaaacacattatcgaaatcctccctgccggttccggaaagggacgtgctctgacggagcttgcctcactgtacggaattgaaaaacaggatatttacgccatcggcgacagcccgaatgatttctccatgtttgaagcggcgggaaaccgcatcgccatgggcaatgcgattgatgaactgaaagaaaaaagcacgtatattacaaaaagcaacgatgaaaacggcgtcgcatatttcatcaaccggcttctcgacaacgggcaataaaaggtaaaagccaggtctttcacggcctggctttttcatgttttctaaaaaagaaatttccaaaattgaaaataaattgtaagataaagaaaaaaggagtttcatgatgtcgaatgcaatcgctattataggatttttagcttttctctgcgcagtcggatacggaatgtttcatctcatatgcaaagcggcaaaataagaaaaacatttttcaaaaaagctgttttggcctcttctcatcggcggatttatcctgcttctgaccggtgcatccctcgcagagccggacgcctcggccgtgaaggcagaggagaaatacagcacccttgataccgcttatcaaaaattgacgaaggaacaccaggcgcttgagaaaaaatatgaaagcatcagtgccgcggccgaaaaggagaaatccgaagctgaagctggcaacgaagaaaaactcagcaaactcagccaagagataagcgagctgaaaaaaacaaacaaatcactcaaacaagacaatgagaaattaaaaaattcacataaaaagctcgaaaagaccgctgaaacgcttcagtcagaaaataaaactttaaagcggcagaaagcagaaacaaaatccgaaaacgcggaaacggcgcaaaacaacgccccttcctccggcggacatgccgaaacgaaagcagccggcacctcacagggatgcgacattaaaggcagccggaacggcatttatcacacaccgggaagtacttactatgaccggacgacagatcccgcggaaatgttctgttctgtagaggatgcggtagcggccggatacagagcgccgaaacggtaaaagaaaaagacgtcagagacactctctgacgtctttttttacggaagccggatgccgcccgcatatttgtccttccaataagcgcttgtgttcatatttgttatggtaacgcctgcggagacggtgacatgaatcacttgtccgttcccgatataaatggccggattcaggctttccgctttaaagaagaccagatcgccgggcttcagatcttgtttatcgaccggaacgcccgcctgcatctgcttgtcggcataacgcggcaggctgattcctttcgctttttgatagatgtattgaacaaatcccgccgtatcaaagccggtttccggtgaaacgccgcctttcagataagaaattccgatatgatcggccgctgtggacacaacgggattgtctttagaaatggctaaattgctgaatcggcgcacccctgtgaaatgttttttccaataatcttccgccaagtaagaaatggtgactttttcggagcggcttgcttggatgaaccttccctctcccgcataaatgcccgcatgggaaattccttttttatacgtgtcgctgaaataaatcacgtccccgggctttatgtcgctcagtttgattttctcaccgaccagccactgctgttccgcagatctcggcaggtaaatgtgaagcttgttttcaaaaacatattggaccagacccgaacagtcgaatcccgcctcgggcgtgcttccgccgaatacatacggaatgtcgaggtaacgggctgcctcctgaacgatcggatcatcagccagttccggatcttttgtcatccgctttgcgccaagatataaattcatccaataactgcttttttgaaagcgtgtgacggttacgccttctgacggagaactgtgtatcatctctccgtttccgatatacagaccgtcatggacaggcgtattttgtgttgaatccgactttttgaaaaacacaagatctcccggtaaaaggtcattttctttgacggcggctccgactttccattgatcactgaccgttctcggcagatggatgttctgcctgctgaaaagataatgcatcaatccggacggatcaaaaccgtcctcaggctcttcgcctccgtaaacatatttatttccgacaagtttttgcgcgtctgaaacgatcaggacagaaacttgagaatccgcttcggcaatttccgttctcgttactgcaggtgccacaagacaaatcataaggccggcaaggatgtacttcctccagcttgtgagcatgttttctattcactctcctcatttttagtagtttttacatcggtaacttttaacaaatgtttaggagagcacaaaaaaaagaatgcccgatatgggcattctttactggattcggaacaaacaatatgccggcaagcggaatcatgagcttattttgcgcccgctgtgtcctcttgctgaattttttgcatttccgtgtcaattttttgtttttcctgatctgtgagctgatcattgtatttaaacgcagacataaacataaataccataatgatcgcggcaaacggccatcctgctttaatgattttcatttgtttttcactccgctttcttttttaagatatcgctgtgatccacatcaaacgttaattttccatccttgacgctccacttgaaattcgattctttcgtcagttcacgtacgatcgttttatgattgatgctgccttttttaaccggtgcaggcgttgcttcatgaatgttcatcggcatgacttcaaagcgtcccgtgccgtttttctgcagatgatattgaacaagcgccgtgtctctcgttcttgtccacccctggtcaaatacgaagttgcccaggctgtagaaaataacggtgccgtggtacatttcgatcggttccagcacgtgcggatggtgtccgacgataatatccgctccggcatctgacattgctcttgccaattggcgctgtctgtcattcggatcattatcgtattcctgtccccagtgtgtttgaacaatgacaagatcggctttctttttggctttagaaatcatcggaataaacagctctggatcggccggaagcacacccggcgcatttcgtttagctgcaaaaccttttccggaaacatcagtgaaacccagtgttgcgattttgattccgtttacatcttgataagaaatgttctgctcggcttccttcagcgtgaggcccgctccgacaagttcaagattttgctttgaaaactcttcaaccgtatcccgcattccttgagggccgtaatccatcgcatggttgttggctgccgtgagaacggtgaaattcatgtccttcaatacttttacggcatctttgtttgactgaaggtggatatttttttctgcttctttgtagttctttttatatgtaaccgggttttcaaagttccccgacacatagtcggatgcttcgaagaatggctttgcgtaacggaagacactctccgtgcctttatgctttgtcactttctcgacattccggcccatcataatatctccgacgaatgaagctgatacaaggtcatcggcatttcttttcacactcggcgtttccgccttccctgtcaggatgcagacgaacatcaggcaaaagacgatcggcagcgcgataaaaacgtgaagattggtcttctttttctgctgtttggtcagcttcagcagtttttcttgaaagcttaattgttttttcatcgtttgacacaccttacattagattaagtagtaagcaaacataatggcaaaagttgcgccgcttaagaacagcgtgctggcgaatgtaatcgttaatccctgtttctgaatggtattggcgatcagacccggtacgatgataccgattccgcggaattctgatatctcaaacggtacgatcgggtaaagaaaatcaagggcgatttttaagcagattcccgttatcagcatagctgcgaattttctgcgtccgtacaaaatcataaatctggataaaccgtatttgacgatcacgtatgtaagaagactcactaacaatacgagtaaaataaagaccggctggttaaaaacgagccctaaataacccggcacgactaaaccggcaggtacgatacctgttttttccgcgaaaattaaactgattaacacgcctaaaataagtgaaatgtataaatctgatccgaacatttatccttttcctcctagctaacgagctgtttcaccttatactcttggattttttcaattaatggttccgctgaaccgtggatattgccgacgccatatatgacacggttttgcattcttgttttcagcacgtccatgatttcgtctgttgatttatattccagatcgtgcagtgtatcggcaggaatcttgccttcttcataagctctgacgatcggttctgtcgtttcgccgatgagtatgagttccttcgttttaatgtacggaagcacgtcgtttgcgaactgaatcgttctgtccacacggtcggcgcggcagttcatgatgacgatcggttcatctgtcgggtagccgatttcctttacacgtttccatatatttaaagtagaagatgcatcatttgcggcaaagccgtttacgaaatgaccgggctccttcgtgctgagcagcggcaggattctcatggcgccaggatcaggcggcgcattcagcattcctttaaacgccgtttcttcatctatcccaagagcctgggcaacgccgagcgccagggaagcgttatcaggaaagaccatatattcaaattttcgaaggtattcatctgtaattttagagttatccgcaataatgacctcggtattccgctctgcggctttttctttaaagaagtctgtgtattcactgtctgtaatgacaaggtgaccgttatacggtatcgtcgcggtaaaagcttcagctatttcatcaagcgtcggccccatgacatccatatggtcttcaagcacattcacgatgacgccgatgttggcttgaaggagttcttcctgaaagataatctgataatccgggtttaccgccatacattcactgacaatggcattggcgccccgttctacggtttccttcattacttctttttgctcgccgatattcgggccctgcggtttccgtttgatcggtttctcctcaggtgtatcccaatagatcatccttgcatctgttcccgtcgtttttccgactgttttgtagcccgcctccatcagtattccggtcgtcagcctcgttacggttgactttccgcggataccattaatattgacgcgtactggcagagcatcgatattcttctgatgccgccttttttcaatgattccgatgattagtacggcagcacaggctataatgagtaaccacattgatttttgacatctccttctgtattgataaattcattcatcagtatatagcttcactatgaattctcaatcggcattatgtaacataatcttcccgctttcactgagccaaacttctctattagtgacgctattcttcctatgatcgaattgctttttttgggaataggcaggacttcaaccttacttcaatttttcaaaagaaaaatgaatgcgtttacatttccacacagaaattcatttggaccaatgggactatacgcgttccggaagaaaaagatgtaatgataatccatcttttacagcctgttatatcagcgttttccgcactgcgcatacgtttcgggactctatgtccgctgtatgcagactgcctgttttgttaaggataaggtcttaaagtcattcatttttcccccgtatcctgctttcagtcccattccaaaataactagcggaatgactggtacgtgacagaaaaagacgggtccggagtgtttacaagaaatacacattttatatgcggaaagcctatctccttttaaagcatttacaggacatttatcactcttttgaaataattttaataaatctttatattcgttcaagaaaagttcatccataattgtgaagttcatggaaaaaagcaagcagtatcaagaaattcctttaatttataaaatgcataaaaaaggaatacccgctgaaaactacagataaccgggaaaggaggcggtctgatgtctgcggataaacaaaacaaacggattcccggcgattttgaatcggctgtacggaaaatgcaggagctgatgtgtgtttgcggcgattttaaaatacgaaggatcaaactgcaggaccgtcataccgctttcttttatattgaacaaatgatagaagaacagaagctgaatgagtttctgttaagcgacaccctgcagaacggtccgcttgaggaaacgatgaatgccgtcagcagtgcggaaacggatgaaaccagaaaactcattgacgggattttggcaggccaggttgtttttctcagcgatgcgtcaaggaaagcgaagctgttttccgtcgggcagaatccgctgcgttccattatggaacccgaatctgaaagtatcgtccgcggcgcccatgacgggtttgtggaaagtttggaaacgaacattcatcagctgcggtttcacatacaggaccgccatctctccgttcattatatggatatcggggaaagagccaaatcaaaggttgcggttatctttgttgagaatatcgccaatccggagattgtggaggaagtgaagcggcgcctgtcatacctgcgtatagacagcgtgcttgcgcccggaattatcgaggagtcgatagaagataattcgttttccatttttccgcagatcgttcatacggaacggccggataaagcaaaagcatgcgtgatggaaggctgtgtgctgatcatgatggatggcagcccgtcggccttgattgcgccgatcacgttcttttccttttttcaatcgccggatgactacagcacgaggtggatttccgccagttttttgagagtgctgagatttttcgcctttatgatcgcgattacactgcccgctttttatatcgcgctgattgcgtttcattttgaagtcattcccaacgatttgattatcaccatgaaaaattcgattgttgatattcccttccctccgctgatagaggccatgattatggagattacgattgagctgatccgcgaagccggtatcaggctgccgaaaccgatcagtcagacgatcggcattgtcggcggtctcgtgatcggtgacgcagtcgttcaggcgggactcatttctaatatgatgattatcgtcgtggccgttacggccgtttcttcttttgtgcttccttcatatgaaatgagcacgtccattcgaacgctcagatttccgcttatgtttctggcatcctcgttcggttttatcggcatcgcattcggcttcggacttattctgatgaacctgtgcaagcttgaatccctcggcgttccgtatttatcatctctgacgccgtttcatttcagtgacttaaaggatgcatttatccggctgccggcttggtttattaaaagaaggcctttttatttgagaccgcaagactcaaagcagatgaaacatgttcgggggtggagaaaagatgaagcctaaaaaaataagccggcttcaaggcgtgtttttcattaatcagacgcagatcagcatcggcattttggcgctgccccatttactgatgatgaaatcgggaagcagcgggtggatttccattctgcttaccggattgctcgtccagcttacattcagcctgtatatgatattattccaccggtttccgaagctgaacctgtacgaaatgctggaagaggtgttcggaacacttgccggcaaaggggtgcaggtgctgtatattttatatttcgcgttcctctgcacgctcattctttctgtatttacacggatattggatatctgggtgctccctcagactccgaattgggtgatcagcctaatgctgatcctcggttctgtctatattgcccaagctccgctgaatgcgatcgcgaggttcagctttattttaacgccgtttttgctgctgatctctctgccgcttttatacacgctgggaaaagccgatatcacatacattatgccgatttttcacggaaccgcaaaagacatgctgaccggggtgcagcaaacacttgtcagcattaccggctttcaggcggcgcttgtgatcgggcccctaatcaactgcaccgtcagccagcgctacaaaatactgacgatttcaaacggcttgattatcctttattacctgtatatcactcttacttgctttgtcaccatcagccccgaagaaataaaaatgatcccggagcctgtgctgtacctgttaaaaaccgtttcattcagaattatcgaacggacggatctgctctttttgacgttttggttcgtgaccgtcttttcaacgctggccaacgtgttttacttggcaagcaccggcatcgccaagctgttcaatcaaaaagatcacagccggtttgtttatccgccggccctgctcgtcttccttctgtctatttgggccacaagcacagataaaacgatacagcagctggatcagtttttccgcatttccgatattgtgtttgtgtatttgtttccgttgtttatggtattgattgtccttgtacgcaaaaagggtgtccgccatgcgcattaaaaaagcggttcttatcagtctcatgtgcgcaagcctgacacttgcgggctgctgggatcaaaatttgctgaaagatatttctctcgtgctgaccgcaagccttgatgttgatcaggacggtaaaaataaaatcgccatcacctatcggaaggttcagtcctcccaggcggaacaggaaacgggcggctcattcattacgacggtgctcagcgcttccgggcacaccatccgtgaagcgcggtttcaattggataagcttgtcgaccagcgcattgacacgtccaagcaaagagtcttattaatcggtgagaaaatggcggaaaaaccgctttttccttatctcgatgtcttttacagagatccgaaaagtccgcttctcgctcatccggcggttgtaaaagacggcgaggcgattgaagtgctgaagctgatcgtccggcagaaattgatcgtcagcaagtatttaacgaatttattaacaagcgctaatgcggaatcaaatatcagcatggaaaatttgcaatccatccgttcaagcatgctgacggctgataaggatttcgcccttccttatttatcgattaacggacagacgataaaggtagagggttctgccctgttcagcggccagcggaaagtgactgaggtgctcggtcaggattcgaccctcctgacccttttaagcgggcaatttaataaatcggctaatattaatctgaagctgtgggacaaatacaaaatggatattgaaaattatctttctctcggcatcacggatgccacgcgaaagattgtatttatagatacagatccgcagcatataaaagtgaaaatccgtttaaagctgaacgcacgcgtcttggaatatccgaaggacaagctgaattcttatacggcaatcaaccaaatgaacaaacaagcatcagcaaatttgaacagccaggccagatcggtgatcagccatattcaggagcacaactcggatatcctcggcatcggccggaaatatcaaacccattattatgagcggggcaagcggctcaattggcgtgaggtctacccttccatcgaaatcgtccctgatatcaaagtgaatatctcgcaaatcggcatcgtgaactaaaagagaccccggtctctttttttgttgccaaccgaaatgattcgtggtactctttttgtgtaaacggttacataaatgaaggaggagtgtttgttggcaacgattaaagatgtcgcagccgctgccggcgtctctgttgccacggtctcgcgtgtcctcaatgacaacggctacgtgcatgaagatacacgaacgaaggtcatgcttgccatggagaagctgaattattatccgaatgaagttgcccgctctctttataaaagagaatccagactggtcgggcttttgcttccggatattacgaacccctttttcccgcagcttgcccgcggcgctgaagacgagctgcagcgggaaggataccggctgatcatcggcaacagcgatgaagaattggaaaaagaactcgactacctgcaaacatttaaacaaaatcaagttgccggtattttggcggccacccattaccccgaccttcccgaatacagcggcagcctttacccggtcgtatttctggaccggacaaaagaaggcgccccatccgtattcagtgacgggcgggcaggcggaaaacgggcggctgaggaaatgctttgcggcaaaagcacaagcatcacgcttgttaaaggcccaggccaccttccgaccgctcaggaacgttttaacggcgcacttgatgtgctgcaaaaagcgggcgcgcagttcaatgtcatctccgctgcttcattttccatcaaggatgccgccgttttagcagaaaaattgtttgcagcatacccggaaaccgacggagtcattgccagcaacgatattgcggcggctgccgtcctccatgaggcgctgcggctcggcaaaaaagttccggaggagattcagatcatcggatacgacgatattccgcagagcaggcttttgtttccgccgctttcaaccatccgccagcctgcatatgagatgggaaaacaagcggcaaacctgctgctgcaattgataaagaaagagccgccgaaagagacggccattcaactacccgtgacttacataagaagacaaacgacgagaaaggatgatcaccatgagtgaaatttgtgttatcggaagctgttctatggatctggtcgtcacatccgaacggcgtccgaaagccggggaaaccgtactgggcacagactttcaaaccgtgcccgggggaaaaggcgcaaaccaggccgtagccgcttcccgtctgggcgcgaacgtatatatggtaggaaaagctggcagtgacagctacggaaaagcgattattgaaaacctgaaggcaaacggtgtcaatacggactatatggaaacggttacacataaaaaaagcggaacggctcatattgtgctcgcagaaggagacaacagcatcgtcgtcgtaaaaggcgcaaacgatgacatctcccccgattatgccaaaagtgcgctggaaaaactttccgtcattgatatcgtgctgatccagcaggagattcctgaagaaaccgttgaagaagtgtgcagctactgccgcgcgcagcaaattccggttatcctgaatcccgcgccggcccggccgctgaaacaatcgacaattgagaatgccgcatatcttacgccgaacgaacatgaagcatccattttatttcctgaccggacgaaagaagaagcgctcgccggctatcccggcaaactgttcattaccgaaggaaaacaaggcgtacgctactcagacggcaccgcggaacggcttgttcccggcttccctgcagaagcggtcgacacgacgggagccggcgatacctttaatgcggcacttgccgtcgcactcgcggaaggacgggacatcgagcaagcgctcctgtttgccaaccgcgccgcctccctgtccgtgcagcacttcggcgcccaaggcgggatgccggccagaaaagaagttgaggagctgctgtcatgaaaaaacacggaatgttaaacagccacattgccaaagtattagccgatctcgggcatacagacctcatcgcaatcgccgatgcgggtctccccgtccctgacggcgtccctaaaattgatttgtctttaacggcgggcgttcccgcctttcgggatgtgaccagcctgatagccggggagatggcagtcgaaaaggtgatagccgcttccgagatcaaagacgaaaatcctgagaatgcaagtttcatagaaagccatttctcagcgcagacgatcgagtacatgccccacacggaattcaaacggctcacacagaaagcaaaagccgtcatccgaacgggtgaaatgacaccatacgccaactgcatcctgcaggcgggtgtgattttctagaaagaagggatccagcatgcatatcggcatgacagacattcataaagcattcggcaaaaaccaagtgctatccggcgtctcatttgagcttctgccgggagaaatccacgctttaatgggagaaaacggagcgggcaaatcgacgttaatgaatctgctcaccgggctctaccggctcgataagggaaacattacgataaacggaacaaatatgaatttctccaatccaaaagaagccgaaaagcacggaatcgcctttatccatcaggaactgaatatatggccggacatgacggtgcttgaaaacctttttatcggcaaagagctgacgacggcgttcggcgttttggaaacgaagaaaatgaaagcgctagcaaaatcacagcttgaaaaactgggagtctctcttcctcttgaccgggaagccggacaatgttccgtcggccagcagcagatgattgagattgccaaagcgctgatgacaaacgccgaagtcattattatggacgaaccgaccgcggcgctgaccgaacgggaaatcagcaaactgtttgacgtgatgacggcgttaaagcgggacggcgtatcaatcgtctatatttcgcaccgaatggaagagatattttcgatttgcgaccggatcaccattatgcgggacggcctcactgtcgatacggcgcatatgaaagatactcattttgatgaagtggtcaaaaaaatggtcgggcgggagctgaccgatcggtatccaacccgcacgccgtcactcggcgataaggtgctcgaagtaaaaaacgcctcaaaaaaaggaagcttttcacagatcagtttccatgtgagcgccggagaaatcctcggcgtttccggcttaatgggtgccggacggacagaaatcatgagggcgctgttcggaattgaccggctcgattccggagagatctggatttccggccgaaaaaccggcattcggggtccgtacgatgccatccgcaagggactcggcctgattacggagaaccgcaaagatgaagggctgctgctggatacgtccattcgtgaaaatatctcattgccgaacctgaccagcttctctccgaaaggcatcattgaccgaaaacgcgaggcggagttcgttgagctgctcatcaagcgtctgaccattaagactgcatctccggaaaccgccgcccggcatttatcaggaggaaatcagcaaaaagtcgtcatcgccaaatggatcggaatcggcccgaaagtcctcatccttgatgaaccgacaagaggcgtcgacgtaggcgcgaaaagggaaatctattcattaatgaatgaactgaccgatcgcggagtcgccatcatcatggtgtcttccgagctgccggaaattctcggcatgagtgacagaatcatcgtcgtccacgaagggcgcatcagcggagaaatcaatgcggcagacgcaacacaagaacacatcatgacacttgccacgggagggcagcggtatgaaaactgaaccaatgacatcaactgaacaaaagcgattttccattcacaccttcacgcaaaaactcggtccgtttctcggcttactgattcttgtgctgatcgtttccgttttaaacccgagttttcttgaacctctcaatattctcaatcttcttcggcaggttgcgattaacgctctgattgcattcggaatgacgtttatcattttaacgggaggcattgatctctctgtcggagccatcctcgccttatcgagtgcattggtcgcaggtatgatggtatcaggcatcgacccgatcttagccgtcatcatcggctgcgtgatcggcgccgtactcggcatgataaacggattattaatcacaaaaggaaaaatggcgccgttcatcgccactttggcgacaatgaccgtctttcgcggactgaccctcgtctatacggacggaaatccgattacggggctcggtacaaattacgcatttcaattattcgggcgcggttattttctcggcatccccgtacctgccattacgatgctgattgcatttgcggccctgtgggttcttctgcacaaaacaccgttcggccgccggacatacgccatcggcggcaatgagaaagcggcgctgatatcgggaatcaaagtgccccgcatcaagatcatgatctattctctgacaggtttattatcggcgctggcgggagcgattctgacatcacgcttaaattccgcacagccgacggccggggaatcatacgagctggacgccatcgcagcggtcgttctcggcggaacgagcctgtccggcggccgagggcgcatcatcgggacgctgatcggggttttgattatcggtacactgaacaacggcttgaaccttctcggcgtatcatctttttatcagctcgtcgtcaaaggaatcgtcattttaatcgcggtgctgctggaccgcaaaaaatcggcatagtaggaggaccattatgaagaaagccatcatcacgatcgcggcattatcactgtttttgctgtccgcctgttcacttgaaccgccgcaatgggcaaaaccgtcaaacacaaaacataaaaaagaattcactatcgggctctccgtctccacattaaacaatccgttcttcgtttcattaaaagaaggcgttgtaaaggaagccaaaaaacggggcatgaaggtcattattgtcgatgcccaaaatgattcatctaaacagtcaaatgacgtagaagatttgatccagcagggagtcgatgcgctgctgatcaatccgaccgattcatcagcgatttcaacagccgtcgaatcggcaaattccctcggcattcccgtcattgcgctggatcgttcagccgaacacggcaaagtcgaaacgcttgttgcctctgacaatgtcaaaggaggagaaatggcggctgactacctcgccgatcagctcggaaaaggcgccaaagtggctgaattgcaaggggtgccgggcgcatccgcgacacgggaacgcggaacgggctttcatcatattgccgacaaaaagctggatgtcgtaacaaagcaagcggcagattttgaccgcacaaaaggattgaccgtcatggaaaacctgctgcagggacatccggatatcaaagccgtgttcgcccataatgatgaaatggcactcggggcgctcgaagcgattaacagctcgggcaaacacattttggtcgtcggtttcgacggaaacaaagatgcgatttcttccattaaaaacgggaagctgacagccacggtcgcccagcagccggagctgatcggaaaactggcggccgaagcggcggagcaggtgctcaaaggagaaaaagtcaaaaaaaccatttccgctccattgaaacttcaaacacaaaaataatcggccgatgtttagacttccggtaaaacgtgaaaggatgaagtaaaaggagagatacagatgaagaaaacagccaaagcggcatccattctgacccttgcagcgggaatatcagcggcttcagctgccggaataacgcctcttccggagacacacgcgcaagaagcggtcaaaattgacgatctgtacagctacccgcttgactcttatctcgtttccgcggaagcattgaacgtcagaacaaaagcatcagcagccagtccgagagctgatacccttcatttaggcgacagcttaaagatcgtttcattccagaacgctgactgggcaaaagtacattataaaaacggaaaaacaggatttgtatctactcattatattgttaaagaagcaacaaccgtaaaaacgacggcaaaaacaaaagtatatacagacaaacaagcggtcaaagcttcccttgccaaaaacacgagcgtttctttcctcggatggaaaaagacagccggcggcggcattgatttcggctgggcgcttgtcgattacgggggcgcaacgggatatatcagcacaaaagatctgcaaaaactgacataatatcaaaacggatttcgcaaattcagcgcgaaatccgttttttctttcttgagcagtcagaaacgtctaaggttcgaaatatttctcaggaaatattgtcggatgaagatgaatgtatacgactctaaaatggcttctttatgtaatccgacaggcgtttggcattgtcacggatagccgcagcatcggcgctgctaaccccgtacatcgcgaaagccggcaaataggtcattcccgtaaaattagccattgcctgaaacggccttaagagctcgctcagtgaaaaatggttggacccgcctgcctgatatgcatcctctccggcacctacagaaacagccagcagcaattctttgccgtgcagcgcctttcctttggagccgtaagcccagccatacgccagcacatgatccatccatgtttttaaaagcggaggcgcactgtaccagtacagcgggaattgaaatacgatccggtcatactgttcacacagctgccgttccttttccccatctattttcccgtccggatattctttataaagctcacggaccgtgatgtcatcatgattttttaattcttctgtccacgccttattgaccgctgagttgtccatgtcaggatgaaccgctaataccaatactttcacagctaccacacctttcccttttgactgtattttacctaatctttgccggttcagccaaataaaaagaaagcccccgagaaaaatgaggctttcttttttattttattccgggcttccttcggttgtttcgatatccttcgcaaaattcggattatctaaatttgcgttgaaaaagtccgccgtattcggaagcttgaggttcatattcattttttgagaaatggtcactttacaatctttaatgacatagtcaaacacgtgtcccccggaattgcgtccttcatcaatgaagtgcaggtgatatccggaaacagcgatgccgtttgcgtaacccggcgtccagaagccggcgattgtaccctgaatgtcgtcaaagttgaacacaggctgtgttttcaccgcttcgatcatcggaacgtacggtttctcctggcgttctaccgttcttgtctgcacctttttaaatacgccgtctaaacggatcgcataaaataagtttttactaggcagaaggctggcgatttcctgctcgaattcttcacgggtcatttcgccgtcgatcgtatgcgtcatgtccggcgtgaaaaatgtgaatgagcagaatggtgacaggtctccgcctttaacaggcgtagccgttccgtcgccgcgcagacggtaaaattcgccgtcaaatccgattaattcgccgtccagtttgttgaacgtgccgattccgaaatcaccgaacttcggaatgtcagccatatcaaaatctccgtcatatactccgtccagcagagatgtcattgtggatacttgatagatctgatcctcaggtgagcctttttctccgcggctcatcatatggatgtcgcttgcgtttttcatattcccttcactccttttaaattgggctgttttagaaaacaggtcatggtgcgcagagtgctagagagcttttgctttcattttttctttgaattgcttcggaagcatgtcgcttgataaatggacattgtcactgtaatcgacaggaatgtcaatgatgacagggccttctgtgttcaagcctttttgcagcacgtctgccagctgttccggtgactcaacgcgcaagccggtggcgccgaagctttctgcatattttacgatatcaatgtttccgaaatctacgcatgatgtacggttatattttttcatttgctggaatgcgaccatatcatatgtgctgtcattccatacaaggtgaacgatcggcgcttttaagcggactgccgtttccaattccattgcagagaacaagaatcctccgtctcctgaaacggatacgactttttcacccggattcaccaatgtggcggcaatcgcccaaggaagcgctacgcccaatgtctgcatgccgttgctgatcaacagtttcagcggctcataagcgcggaagtagcgggacatccagatcgcgtgagaaccgatatcgcaagtgacggttacgtcgtcatcaattgcactgcgcagttcttggacgatttgcagaggatgcactctgtcggatttatgatcgcttggcgccttctcgctgtctgtgagcatctgttttaactcgctcagcacttctttttcacggctgcccatatcaaatgtcacagcgtcgtgttcaatttgtttaaccgtagcggcgatatcgcctaataattctaattccggctgataggcatgatcgatgtcggcctggatttcgtcaagatggataatagcacggtcaccgtttacgttccagaacttcggatcgtattcaatcggatcataaccgatcgttaatacgacatccgcctgttcaagcagaagatcgcccggctggttgcggaacagtccgatccggccgaaatattggtcttccagctctctggacaatgtgccggccccttggtacgtttctacgaaaggcagttttgttttggcaagtagtttgcggatttgttttaccgcttccggtcttccgcctttcatgccgactaacagaacgggaagtttcgccgtctggattttcgcgatagccgcgctgaccgcttcttccggtgcagggccttgtttcggcgccggcacgctgcgtacgtttttcacatttgtgatttcattcacaacatcctgcggaaagctcacaaaagccgcgcctgcctgacctgctgacgctgccctgaaggcgtttgttaccgcttctggtatattccctgtttcctgtacttctacactgtattttgtaatcggctgaaatagcgccgcattgtccaatgattggtgtgtccgttttaaccggtctgcgcgaattacgttacccgccagcgccactaccggatcaccttctgtattagccgttaacaagccggtcgccaagttggatgcccccgggcctgaagtaacgagacaaacgcctggttttccagtcagtcttccgacagccgcagccataaatgcagcgttctgttcgtgacggcataaaaccagttcaggtcctttatcttttaacgcatcaaatactgcatcaatttttgcacccggaatgccaaaaacatgtgtgacaccttgctccactaagcaatcaacaacaagctccgccccccgatttttttcagaggtttttagttcatttgttgcttttgccaacaccctcactccttattatgcatattaaatataaaattttaagtaatttgtgatattattcactatacactctttggaaattgacctccaatatcaattcgccgtatgattaatatgtttcacgaataattaacaaagagaaaggaatggataaggatggagcttcgccatcttcaatactttattgccgttgccgaagaacttcatttcggcaaagctgcgcttcggttaaatatgacacagccgcctctcagccagcagatcaaacagcttgagaaggaagtcggcgtgaccttattaaagcgcacgaaacgggttgtagagctttcagctgccggagaaagttttttaaaacacagccgaaacgcgatcgaagaaatagacaaagcgattgaaatggcgcagagaacggcgcggggagagctcggccgccttgtcgtcggttttgtcggctcggccacatatgaatttctgccgccgatcattcgggaattccgcgaaaaattcccctccgtcaagcttgatctgcgtgaaatttcttctttcagacagcaggaagaacttctgaaggggaacattgatatcggcatccttcatccgcctttacagcattccgcgttacatatggaaaaggtgcagagcagtccgtgcattctggctttgccgaagcagcacccgcttaccgctaaacagacaatcgacattcaggatttaaaaaatgaaccgattatcacactgtcgaaagaaacatggccgactttatacctagagtttgtaaactactgcgagcaggcgggcttcaaaccgaaaatcgttcaggaagcgacggagtatcaaatggtgatcggattggttagtgccggtatcggtgtaaccttcgtgccttcttctgctaaaaagctgtttaatctcgaagtcgcctaccgcggcattaatcaggcgcagctcactgccgaatgggtcattgcctaccgcaaggataatcaaaatccgatcctgaaacattttctggatattatgaataaacgccaggctttattgcaggcggataaggaaaatgcataaaaaagagggccgccgaaagcagcctctttttttgtgcttttatggatttttactaaattggtagaaacgctcagtacaccttacgacctgtacccgtatacatacagtacaactgatcaggagggataaaaataacggggcggcaatgacccatctaaaaggaggcagaacacattacacatattaccgtcattttgaccctgatttctttctttgtgaccattatttttatattttggagacccgggggattaaatgaagccgttccggcgtcgctgggcgccattctcgttttgttatgcggaaccgtttcctttcatgatttgggggatatagggtcaaaagtcaccggagcatcaataaccattatctccacaatgattatggcgatcgcgctggaaagcttcggtttttttaactgggcggcggccaaactgcttcaccgcgccaagggatcgggcatccggcttttttggctgaccaacctgctctgtttttcaatgacgctctttctgaataatgacggcagcgtcttaatcaccactcctattttactattggtcttacaatatctcggacttaaaagacatcagaaaacaccgtatttaataagcggcgtattaattgcgacggcggcaagcaccccgatcggcgtcagtaatatcgtcaatttaatttctctcaaaatgataggcatggacctttatttgtacaccaatatgatgtttatccccggcacgctgggactggtgtttatggcctttctgctgtttgccgttttttaccgccgtttgccgaaacagctccccgatattccggttcattttgattcgctggaacacaaacgatatcatccgcttcagcctccgccggacttgagccaaaacagccgtacgaacatcatgttttgtgttttggtatttgtattgttcgtccggatcagtctgtttgcagcttcttacaacggcatatccgtttcgctcgtggctgtcatcagttcagtcatcctgctttgctggagatggttttatttaaaaatcggaccggcagacttattaagaaaagcgccttggcatatctttatttttgccttcacgatgtacattatcatctacggactgcataatatcggactgacggcgctgcttgttcagtctattgagccttatgtctcacaaagcattgcccacgccgcaactattatgggcattgctacatccgtcctctctaatttgttcaataaccatcccgccttaatgatcagcactttgacattaactgaaatgtccatcgacccattaaccgtaaaaatcatttatctggctaatattatcggcagtgatatcggatcattgcttctgccgatcgggacattagccacgctgatctggatgcatatcatcagacagcacggcgaaaaagtttcttggtcagaatatatcaaaacgaccattgtcgttgtccctctcaccgtcgtgtttaccattaccgttttatatgtttggatcagttggatttacctttagctccgatgaaaaaaaactgcctgctgtataagagaggcagttttatcatttatggcaggtgcatggtttttaaatgattcaatttccaaaaaacagtatcgccgtctgcattggtcaattcaagaatattatctgagacatcctgtaacagccccactttattcggtatatctcctaaatccagaataatcagcttcccgatatatctttttaattgctcctcaaaattccggacaaggggcacattagcgggaacaaccggcagctctgaactgtttaatgtatacggcgtctgctcatcggaatagggtgtcagccatttcaaatgatgcatcgagatgaaaagagtcttataaaccggagagaagaaaacaaaataatcatttaaaacacttgtcacatacccatggatggaacggtctcccgtaacaaatatttctgtaaatctgccttttatatgctggagggtattccggtaagaaaatgaatgttcctgtttttcgggatgcggacttttttttcttgcgtacggctctttattctcttcgtccgggagcgtcaatgtcatcctctgaagatgcagcagcggaatataaagaaacgtccggccgtcatgaatcacaatgatatcctgaccgatatccaaaagagttcctgaaaatgtcgtattccccgatatctcaatatcgacttgtttatccagaaatctgcttaatccagccatttcattcccccctctcccgcgtttacggacaatctttccaatcatttacggccgtgtttccaccgataatctattgtccttaatacagtggcgtagctataagaattctcttcctcccgttttgaggatcgaacggatcttgatgatcttttcgactttttagaggaagtacgctgctcttcgcgtgattcttcttcatgtgacttttcttcttcggcgctctctttctcacctttattctcgtcgtctttattctcctcttttttagctgctccttttgccccttcgctgatgctcttgatatgaaaaggatagatccgcagcacttctttatctttcacaagagtgtagtggccgtcggaattatccacaagtataccttcaacggcttcaggacctccgcggttgatggatacccatttgtggatcaggcgtttaaatatgccgtgaaaatcatcagccatttcaaattccgggcgctcctcctcttggccgtcctcttcttgttccgcgctgatgcttttgacatggtcggcgttaaaatatacgattccgtcatcttccgtttccagcacgagaaaatcatcccctgtttcgtgaagctttcctcttttcgattcgggacctccctgattcaattgcaccgtgcgattggtcatccggctgatcaggtcttgaaaatcatcagctttttcacattctgccgcttcggccggcgatacggtttcactcgtattttccgtcacacttttcacgtgtttccattgataataaacgattttattatcaacctgaagagcgatataatccgattgaatgtctgctaatctccctgtcttggactccggacctccccggtagacagtaattacttttccttccattgcatgcaaaaagttgtcatcagaccgatgccgcttcgtattgcgtttcatctattatcctcctagtcatttttctcataatgtaaaaagcataatgcatatatacgtatcacgattattttcgggaactgattcaccagcctatttgtaaaaaatctttcttcatttccaaatcagatattccaccgctctaactcactgctgatgaaggcggaccgctccttaatgtattcgcaaatcacatcaggctcccggtcaaagcaatcaatctcctctttcttataaggatcctttgcgacatgcggcctgatctgctcatacagtgacatgaccttcggcttcatatgttcaatggtaaaccgggtctgaagcgtttcttccaaaagctgtttgtacgctttgcggaaatacggttcatccagaagccttgcagtcaaggtattaaacccttgtattctgacataatcggcgtccatccgatcaccgtgaatgtctcttccccacgtcgcatcgtaatcccacggaatgacttcaaaaagtcccgtttcatgattccggtacaaagcgtaattatgaacaaacccatcgtagtttgaggtaaacacgatgcccgcaagccaccgcaaatacttatcggcgtccaagtgtttgacgatctcccccttgaactctgacttcggcacggtattaattttatagatcatgtcctgcaagtataaatcgtcttctttcgttcccgttttcttttcataaccaagttcgagcgatgtttttgtatcccgctccagatcactgacgagggagaaattggcgtcgtcatcaaccgcgtaaaaaacagccccttccgccaaattccgtttcgccagaaaatattcatccactgactccagctcaagatacaccccctcatgcctgccattgatttgcagggttacgaaattcgcctttggtgacagcgtcccaagctccgcgaagaaatcgagagacagcttattcctcatcatcgacggatctttgtattcagcgtttaaatgtatctctttcgccctgcgaaatgttttcggcgaataaaaagcgatgtgatacgattttttcttgaaatctcttatatgagagccgcggtacgccagatcaatgtcaagccgtttttgattcactctcagcaccgcgggcaccggatcatcatcccaaatgtcttttttcagctccattaagtctttcgggtgaataaacagctggtacagaggcaatgttgattggtctttcatcagtaaccctccctgtattaatttaggctgtgctttttatataaaactcagcgaatcacacatacacttttttcattcatgcgtactatgtggtagtaaggatcgcatccttaaaacatatatcatgaggaggtttcaaaatgggccactattcccattctgatatcgaagaagcagtaaagtccgcaagcaccgagggattggaagattatttgtaccaagaaccaaaaagcagtaagaagagaaaatctcgcagtcataaaaaatcgtgccgctctcacaaaaaatctcgcagccataaaaaatcgtgccgctctcacaaaaaatctcgcagccataaaaaatcccgttctcacaaaaaatctcgcagccataaaaaatcccgttctcacaaaaaatctcgcagccataaaaaatcccgttctcacaaaaaatctcgcagccataaaaagtcccgttctcacaaaaaatctcgcagccataaaaagtcccgttctcacaaaaaatctcgcagccgtaaaaaatcgtgccgctctcacaaaaaatctcgcagccacaaaaaatcatgccgccgcaagaaaaaacgcacgcagaaaaaaccttatcgtcctcataaaaaagacccttgcaaaaaagacgattactgcagcaaaacagagtactggaaagacgggaacatctgggttgtaaagaaaaactacaagtaacgccatttgtaaataggctgccggctaaacggaagcctttttcctcaatcagatatatgccacgtgataagatatgcagccggttttcttttgttgtgtttccgaattttctttctgtataatcaggtcatacgataaagaaaggcggccgaaatcatgcatatcttacgagcagacgaactgaacgcaaaagacacttacaaattgctttcgggcacagtcgttccccggccgatcgcatttgtcacgacgcggtcatccatcaacggcgccgtaaacgcggcgcccttcagtttctataacgttgtctccgcagaaccgccgcttctggccatctctgtcagccgcgcggacggacggcagaaagacaccgcgagaaacgcaatcgctcatcgggaattcgtggtgcacgtcagtgatgagtccattattgaagatattaacaaaacggcggcaaggcttgatcctgatgtcagtgaacttggcatgacagacctttctgtgacagacagcgcctgcatcagcgttcccggtataaaagaagcaaaagtcaggtttgaatgtatactcgaacgccatcttccgtttcaaaatgacagcggagaaacgacgacagacctcatcatcggcagagtcgtttgttttcatttgaatgaccaagtatatgacgccgataaaggctacatacggacagatgagctgaagcctgcggcaaggctcgcggggaatgaatacgccagactcgggaagacatatacgctcgtccgcccgacctgaagcaggaaccattataatagaagaaactagtcaaaaagacccctttcaaaaggggtctttttgagtcttttaccattaaaatccgcctaatgtcttatagaatgctgaaacttgcaaggccctcacccgtatgaaacgagtgacacatttttaggaggcagacgatggatttcattcagttactgattttttcagccgtatttattttgctcagccttatgtttcaagtatttgccgtcaaagttctccattttccaaatcccgttaaaaagcagaagccgataaacagcacatatcgattaatcgaaatcacactgcttattacgggcatcgcagcggtgacttttttcaatgaaatgtacgtatttgccggagctgtttccatgctattttgctgcagcggcttaatggaatggcggcaccggcgggaggaaaagcaatatgtgtacgattcgttttacgcgggtctttctgccgctcttggcatgcttatttttttcatcagttagcgtatcatgctctatactcctgcggccgctccgtcgccgcgcgggtcggccccgccttggagaaagccttcttcatcaatgacgatcgctgccgcatggcccataagcccgtcaaaatcaccaacggtctcgacgcggtggccgctctgccttagggcttctctcgtttcagggctgattctgctttcaaccctcagcccttcatactcctctccccatgtccgtccccagacccagcgaggctcattgatcgcctgctgcgggtccattttgtaatcaatgatgcgcgtaatcatcgctgtctgagtttgcggctggccttctcctccctgggttccgtacaggatgtgcggctttccttctttacaggccatcgccggcatgagggtgtggaacgtccgcttgccgggttcgagcgtattgacatggaattcatccagcgaaaaaaatgacccgcggttttgcagtaaaatacccgtctcccccgccgtaacggcagatccgaactcgaaatagaggctctgtataaaggaaacggcatttccttccgcatctctgacggcggcataagcagtgtcgcttccgaccggacggcttaccgccggcgcagccgtgtaaccgatttcttccgccagctgctttgcataccgtttatcaagcagccgatccagcggaatatgagaaaatgccggatctgtcagcacttcattccggtgctgaaaactcttcttcagcgcctcgatcagcagatgataatattcaaaggaaccgtgttcaatctgagaaaaatcatagttttccaatatattgagcgtcattaagcctgtaaagccctgtgaattcggcggagcctgatagatgcggtacccgcggtaatcagaggataccgggttcgtccactcgccgcggtgggctttaaagtcatcaagtgtcagacggctgccgttgttttgcagaaaggatgtgatgctttgagcgagatctccttcataaaaagcgcctctgcctttctcggcaagctgttccaagctggccgccagatccttctggacaaaccgttcaccgggcatgggcgcttttttgtttctcgtaaaaatggctgaggtataaggtgttgaggctaaaagagcgagattgcgttctgtgtgggcgcactggtcggcggacactggaaatccgtttgccgcataatcaagagcaggcttcagcacctcagcgagcgaaagacgcccgtacgccgaaagcacggcatcccagctgtccgccattcccggaacggtaattgcgctttctggcccgcgcagagggatcgcttctctgccccgatacaagtctctcgtcacatgcttccctgaacggccgctcccgttataagctttgattcgtcccgtttctttatggtaagtgagccaaaatgaatccccgccaagacccgtcatgtgcggatacacgactgccaggcaggcgctgaccgccactgccgcgtcaaacgcgtttccgcccttttccagaatgccggcccccgcctgagaagcaagataatgcggactgacgaccatttgtttcgttccgatggttgaagtattcatggcaagcccctttacaaattttctcaagtataaaaagcggcttcaccggtatccactttcctgaaagaaaagctcacacactatttactttccgataagaaataatcctaatttattacgtaacgaaaacaataaaaaaatttctccttcataccgtaacatttcatgttacaataatatccaccaaatgaaggaaggtgaagccggttggaacatgagtacagcattccgaatcttgtccttgatgaaacggataaacagattctctcgattttgcacgaggaaggaagggtttcctatacagacttaggaaagcgggttaacctgtcgcgagtggcggttcagcaccgcattcagcatttactggatgccggtgtgattgaaaaattcaccgctgtcatcaacccggcgaaaatcggccgtcatgtgtccgtgttttttaatgtggaggtggagccgcagtatttggaggaaaccgcattaaagcttgaaaaggagccggccgtgacaagcctttatcatatgaccggaccgagcaagctgcatatgcacggcattttcgcaaatgatcaggagatggaagagtttttgacaaaacggctctatacgcaaaaaggcgtcgtcagcgtcgactgccaaatgctgattaaacggtataaaagcagaacgggcatgaagctgtaaggaggggacatagccatgaaacatccctattgggacattacggcggcgatggtccgaacgggcattctcggattcggaggcggcccgtcggtgatcccgcttatccgccatgaagcagtcaataaatacaaatggatagatgatgatgaattcggagaaatactagcgatcgctaatgcgcttcccggaccgattgccacaaaaatggcggcgtatctgggcttcaagctgaaaggcacgttaggcgcaatcgcggcaaccctcgcacatattctgcctacatgtctcgctatggcgggcttgtttgcggctgtcaatgtcttaagccgctcagcaatcgttgccggcatgattggcgccgtaacaccggtgattgcggtcatgctcggcatcatggcgtacgagtttggccaaaaagcgcttaaaggtttcggctgggtcacgggcatcctgttttttatcatcgcttttatcggcctgcaaacgttacagatcaatcccggctttgtcattatcattttcttagcgtacggcgcgtttcattttaaattaaaggacaaaatcacaaataaacgttcaaaagataaaggaatgtctgcctcatgatcttgatttatgtatttatggcgttttttgtcgcaaacgtactcggatatggaggcggaccggcgtcgatcccgctgatgtttgaagaagtcgtcaacagatacagctggctctcaaacgatcaattctcaaatatgctcgcacttgcgaacgcattgccgggcccgatcgcaaccaaaatcgcggcgtatgtcggctacagcgcaggcgggtggcccgggttcctgattgcgctgatcgccaccgtcgtaccgtcggcgctcgcattgatcgtcctcttgcgcatcattcagcgcttccgccaatcccccgtcatcaaaggtatgacgctgtccgtccagcctgtcatcgccgtcatgatgctcattcttacctggcaaatcggcgcagacggcatcaaagcgatcggctgggttcaagcgatagtgattgcggggatctccctccttgccttgacaaaattcaagctgcatccggccttcctgattatcgcggcgtttttgtatggagggcttgtgattcctcatttataaagaaaagcacctggacaggtgcttttttattttggccccgcaatgccgtttgatatgacaactgtttcttcgcctgcatcactcttgatgatttgcttaacttgcagcgttgcgcctgccattctcacagattgctgaacctgaggcgaattggtttcagcctgtacccaaacagaagtcggcgctttccaagctagaaagagtgcaagaatcaatataccagagataaccagcagcagcttcatatcgcatcacttcttttcaataaacggctcgcagcggacagagcctgatgatcatgaagaatatcaccgggacgattgccttctcccagcacatagcctttaaaggacatccccataaaatgaaaaatatgttcaaattgctgaatcagcggcagccctttgagtttagggttgtcccctcccactgctgttacatatgcctgcttcactgacatttgctgtttaaaatcaggaaacctcggatctctcagcgtctgtgaccagcgatcaataaacagctttaatgtccctgacatgccaaaccaataaattggggtggcgaatacaagaatatcgcgcgataaaatccgctcaatgatagaatcgcagtcatcttgaacaggacgaaagccgccttgggcgtgacgcagatcttcaattggccggatccgatatttccgcaaatgaatgtgctccgcatcgaatccttgaacagccttctccgcaagaatatccgtatttccgtcaggcctcgttccgccatgaataaccgcaatgttcatgatgcatctgctcctttgtttacgaatgattttcttcatcatataatggattcatcgatcaatacagatgattatttcgattgtttcaatcgataaaaacgatttagaaagggcgagatcaaatggaattgaagcagctgatcacctttattaccgcagcagaacacgtaaacttcaccctaacggccaagatgcttaactatgcacaatcaagcgttacctctcagatcaaatcactggaagaagaaatcgggactcctttatttgaacggctcggcaagcggcttttcctgacagaagccggcaaaacgttcaaatcctatgcggagaagatcattgcgttaacagaagaagcaaaaatggccgcaaatcaagcaagggaaacaaccggaaccttgaaaatcggtgcgacggaaagccagtgcacataccgccttccgcctatcataaaagaattcaaacaggcttttcctcaagtaaagctcatattcaaaccgtatatttccaacgaacaagcgaaagaacagctcttgcagggccagcttgatatcactttcattttggatgtgaaccgaacggaagacgcactgcacgttgaatctctgattcaggatgaaatcaaaatggtagccgccaatgaccatccttttccagcagactcaccagcaacattgaaggatcttcaaaacgaaacccttctgctgacagaggacggctgttcatatcgcacgctctttgagaacactttacatgacgccggagtctaccctaataaattagaattcgtcagcatagaagccatcaaacaatgcgtgatggccggactcggaattggactattgcctgaaatgacagtaaaagacgatattgccgaaggacggatgaaagaactcaactggcagaatgaatgccccgtttttactcaactagcatggcataaggacaagtggatgtctgcaccattaaaggcatttatcgatttgacgcgaaaaacattcaaataaaaacctgctgcgaggacgacaaagtttttaataaagcggacaccaggcatacaaaaaaaacacttggtggcttaaagccccaagtgttacacgtgatttttccgataaaacgttcgcaaaacatgcgtttcaaggtcagccagacggacagggatcggcagcctgctttctcgattgatcattttcattgtgatctgatagctgctttctaaatcaatgttatgtccgcaagacaagaagataggcttcacgtcccgccgtgtccgaagcgcccggccatatacctcgccgtcaatgagaatatcggtgtaggcgcctacttcattttcaggcatctcaaaatcgcagcctttgattttaagataggttttcgcaatcccaatcgtcggctttcccagaaaaaaagccgcatgagtggcaacgcccatatgattgtaatgcagatacccgttgccatcaaacaagaagacatccggctccgtctccagctttttcgccgcctcgatgatcaaaggcagctcgcgaaacgcaagaaaaccggacacatacggcacgctgattttccccatgctgtgcaccttttcaatgacttcttttgtatcagcgtcaatcacgatcatactgcacaccccgtacggttccccgtcctgctcccaataggcgaggtcgacgcctgcgcatgtattgacggattctggatggatgacgggggataggttgattttatgtataagagattgttgagttcgaataaaatccgattcatctttttgttcaaaatcgtgaatttgatgtattttcatttcacttgttttcctctcttcgcgctcaattgtcctgtgtgtcgatctagcgaagactccttatgcttcattgaaaaaagcaaatagtataatctgctttttattaatattcatttttcatttctttcataaaaataagatccaattgtttaagtaattctttaagttcagtacactagaggattttcccaatcttcgttttttatcagttcaatgccataactgccggttggatctccttctgggtaccatcctacgtcaagcagcaaattttttgtcttatgagaaatctgcaggagatcttgattaaagtcaaataaccaagcatcatcattttcctctagagttttaggatcagtatcttttaatgtaatataatcaacagtccaaccagccggtatcttaagccttaagaaattgggaacatgttggcttagcggctgcaaaccctctaaaaccccacttcccacagtccagatttgatattctaactcttccaataattgttccatttcatcaaaagattcatcttcataaatcttatctgtttttaagcccgctactatgacatggtattgatcattttcaaatattaccttaataacagcattacgtttttcattttgtagttttagtaattcatatttttctcgcattcttttttctgaacttaaattgttcagtactacagaccagccattacagatttttaatggcagcaattgagaaatatggtctctgtccatcctgcttctccttgtactccacattgttaaattattataaaaaaacttgccgataacaacacggcaagctcttaactatagcaattctaatacatcagtaaacaaggcatctcctaatgttaatctcctgttgaaaggctgtatatgtggcaattcactccactcatacacagtatcgtagtaatcatacaaataactgagttcgataaaccctttctcttgcattattttattaatatagttcgttccctgaatgaattctaaagattcagttaaggcttttcattactagaggttattgattttgtctttataaacttttaaaattgttgtgtttaaatcactaatttctgagaaatgccattcaaacgtcgttagaattctatgaagttcaaataacattttctctatttcatcaccatcgttcttatccaatgaaccaaaattgtttaatataatatctaaatctctagttaacaccctaaaatcctcaaggttctcgtactgttcatctaaatcttctttatttataatattaatacttgaattaagtttatctagtatgtccaatattccttctaactttttatccatatcaattcctccactgttatttccaccccttaactactcgtccaagtgctttcttagtcttgtcagggtttaaagtaccatctaaattcaatacgtatttcacatttcccgtcttatctattacttctaaatggtctttgtgtaatgcgtcaagataaactccataaccctttttcagatattggttatcagttttcttttccaccttataaattgattgtccatcgtactttacttttgattttgataaggaattacttattttttttccaaattccatatcaaaaaactcattcatatttgaaacaggtttaacaatacccttaatacctttaccactactagccatcttcacaatcccaagatccttcacagccgtcttttctacatctacccggactgtcgggattccgatcgtgaagccatccggagttactgggcgttctgcgtacacgcggacgtttgtcgggactttgaattgtttaactttttctagtgtcttgttagctttttgaacttttgaatgggttgcaagcggtatgcctttgtttacatgcttcgccagtgcgccggcaccaaccaaactcaacgccgcttccagcgctccttgcttccgtttttcctcagacactttgtttccgaacatatctctgcctgtgacggcttctgagaatccgtttgaggcgacgaggccgtatgcgcccatttctgtcattttgagaatgtctaaggattttccggttttataggcatctaaagcatgttctgcggcaatgacggtttttccggttttgtaaatggcttttccgcctttgaaagcgcggcccgcccagccgacgaccggtatgaatccggcggcggccatcgctcctgctgtgacgcgttctgcggtggagagtttttcgccggtcaccggatcaacgccttcagctgctcttttataatcataatagccggtgacttcgccggtaaagttgcagatgccgtcccatgttttttcgtaccatggtttattggcttcttcttcagccttttcctgaagccgtcttgcttcggcctgctgggcttttgcgtcaatatagtccgtgccctgtttttctgtcgccttgacgcttttgtagatttcattgctgtggaaggcttttttgtcatagtacataggggaggcgcttttcccgttcctggtggcctgcatgagaacggaatatttgctgagcactgcgttgtccagagattctaagttttgatattcagcggtcagggattcatcaagcgtatcgactgccgtgatcgtgtcacgtctggttttctgggcatcacccattttatctgcgtaatcatccagcgtatatgtatcgagatgaataatatcgctgatgccagacaaaatcgaatcgatttctgctttatgagcggagacaatctctgaagctctcaaatccgcattgggcagctcatgctctaaaaacgaagtctccgcatatgaatcgctgagttcttgatctttaatgtcacctgaaatgccatttaaaaacgcaatttgagcagagacaagcgtcagccagctgtcggcgatttccgcttgtccctgaaaaaaatcttttatattgtctgcgcctttccctttcaaagcatcacccagatcggccacgccttgaaaggcttgtttgagcgcacgcagctgcccttcaagggcttcgtattgtttctttctcttatctgcttcgtccgttaacgattgtgattcaaacactttgctcatcggcaagtcctttctttcgttattttacggcgatcgcctcgtcctgttccttcaaagaatctacgttgtctttaacgtccgcgatattcttatgaacggcctgcttgtattcgctgatcatcgatacaagctttgcctcgcgtgattggtatttggaggtatagtcgagcttgttttttccgtttgaaccggcgttcccgatagaaacggcctccaaagcgctgctgacggattcaagctgcttcatgacggctccgtatttgagttttatttctgccattaaaaccaactccagctttttttgattgattgtattttttctccgaccgtgtcaagggcttcttctcccagcgtcagcaggtgctctgcctctctcgcgatgcttctggcggcaaggagccctcctttttcaatttcaagctgtgtcatctttaagccgattcggtaaatataaccgtcgtatttgtctgtgacgattctgtatgcttctgtatgggcctgatcgcgccggtcatcaaattcttcagcaaaagtgccggtccaatgatgatccaggtgcggcctgaggatgtctctgatttcagacacgccctcttcctgcagagattctatctctcttttcgcttcttttaatttatcaatttggtgttcgatctcgcccagtttatggctgatcgtgctgttaatatggcttaatgtgcttgaatggctcatctgttttcacctcgtcttacgcaaaaagtcgtacaaaaagcacagacttttccatactatatttccatatattatattttaaaatagacagaaagcagcttaaataggttaaatgacttattttcagcagccgagatgctcatcattaacgccaaaagactcacataaacggcatatccattcattgatctcctctatgtatccatgataaattccctaaaaaaaggagacagtgattaaccgtctcctttgccttgtatcatgagtctaatactgtcgttaactgcagtcccagttgtacaaaacgtttgagaaatcttttttcttcaaatcttccggtctgataaagaaattggcgattcccacatctccccacatcgaatcaatgtcatcatctgaatcaatttgcaagagcagaatcgtatggttttgatgggaataagaccgcggatcttcctgggtgaaggacgcatagccgccgattttatggccgaatgcgttcaccgtatattcgtcatacacctcatcgtcaaactgctcgaaatagtcgaaggcatccatcccggcatattgcctgaattgaaaatcagacgggagcacccattcagcagacagctcaggggtgatcagcgcttcggattgaatcggaaaatcgtactcctcttcaacctgaacgaaagaaaaatcatccatgagctcctcttcccgatctgtcacgtgctcaaaatatttgacggagaaacccgtttgcgcgcacccgtcgtcaaaattcaaaccgtatacgtcatcactgaccgatacgtaaaactgaagaatgccggtgtccggaaaatcaggaagtccgggcatatccgcaaaattgatttgggcgagaagcttcatcggcctgccgctttcatcttcaggatatggttcatgtttcggaaaataggggtctccggcaattttactgtcataccgtcccgtttcagcttttttgacgtgcagtttgataaagggccgtgctgacgtttccagcagaccgcgggatgattccatttgcttcggcaatttccatgtgttttccacgattaatatctccttcgtctctaatgattgtatgataaaaggccggcgcggaccgccggcctttcaagtgacagaatcagtctgaggcacgacggctcttcttccgattgagatatattccacgccggcctgttccgcttcctcaagcgagtggcagtttctcccgtcgaaaataaccggggtttccatcagctctttgtacgcttcaagcgggaagtgtttaatttgttcccaatctgtcagaatcaggacggcatccgctcccctgacggcttcttctatggactcccgataggaaaccgcagccggaagcagcccggaagcccggaatgaagcgatcggatcgtacgctgtcatccgggcgtcaagagccgccagacgatccgcaatgacaatggacggggcatcccgcatatcatctgtattcggcttaaaagacagccctaataacgcgatggttttccccgtcacaccgcccagcctgttcagcactttatcaaccagcatggactgctggttattgttgactttaatgacggacttcagcaattcaaaatcatgctccacatgtcccgcgatctgcacgagggcgtttgtatccttcggaaaacaggaaccgccgtaaccgatgccggctcttaagaattgattgccgatccgtttatccaatcccattccgtgtgcgactgattccacatccgcaccgactttttcacatatatgagaaatttcattaataaaactgatttttgccgctaaaaatgcgtttgacgcatatttgatcatctcagcgcttctgatgtccgtatgatataccggaatcgcaagcggcgcgaaaacccggtcaagcgtttcccgcgtctgccggtcttcagccccgatcacgatgcggtcgccgtgaaaggtatcgtgaatcgccgaaccttcacggagaaattccggattcgaagcgattgaaatgttcacgtccgctctcagccttgaatgaataacttcgctgatcctgtcattcgttcccacgggaaccgtgctttttgtcacgacgatcgcatctttagaaatatgttcggcaatccgttcggcgacattttcaatataagtaaggtttgcgtgcccatcttctttttgcggcgttccgaccgctataaaaataacgtccgcttccgcaagccctttttcgtagcttgtttcaaatgccagccgatgccggccgatatttcgtttcatcatatcttcaaggcccggttcaaagataggggacaatccctttctcatctgctcaaccttacgttcgtcaatatcaatgcatgttacgtcatggccgatttctgaaagagacactcctgtcacaagaccgacgtagcctgttccgatcactgttattttcatcgtgttcccccaaccgtttagaaattgctgctgggcagcttaccgttattatcatatgatcccggcgccggcggaatgccggaagcctgaggccatgataggaaaaaacggcgccggccgctgataatagcataagcataaacgaatcatcttgcaaaacagccgcttacgcttcatttaaacgggatggagacgacgattaaaaaagaccccagcgcttacggcgggccacaggcagcggaggttccttataaacggctttgttttcagtgagaagcgccgcattttccgtaagcatgtaaatcagctccgcccctgcttcttttttcagaacgccgagcgcctcctgataataaaaattcctcggtccgaggttatgggcgtcagatgcgagaaagtggatcaaattcgcttccatcagctgcagcgaaaaggatttcgctttccgcccgaatgctccggcaatgcagccggccgtcacttgggcggccgcccctttcttcacaagactgtaaaggacggaagggttttcgcgaatttccctgttccgctccggatgggcgatgacggggacatatccgttcagctgcagttcataaaacagcctttcagcgtaggccgggacatgatccgccggaaattccgccagcacatactttgtattatggagcgggacaagcgagccgctttgaagacctgccagcagatctccgtctattctgatttcctggccgggcaggacagtcagcggaatgccttccttattcaaacgtttgtttaacaggctgaccgcttcgttgaccgtatgccgatccgtgtcatagcggtatttcacatgatgcggcgtcgcgatgatcgtatcaatcccctgtctgaccgcttctctcgccatcttcaggctttctgtatcatccgccgcgccgtcgtctatggaaggaaggatgtgacaatggatatctatcatatttcaatccctccttaaaaagaatggaccgcgcccattgtgacattattgtccgtaataggcgtagtccgaatgtttcgtttgtttcttcccgttcataacggccccaaggagcttgcacgggcagtaatcgagcgcttctttcgccttggccgctttttccttgtccgttttcccgcttgagatcaccataatggccccgtcagtgtagctgcctaatattttcgtatcggctacggccaaaacgggaggcgtgtccaaaatcaccttatcataaactgcggctgcttctgacagaagatctttcatggcacccgtcgataaaagctccgccggattgggcgggatcggcccgctcgttaaaatatccaggtttgcttcatcagccggcaggacggctttctgaaacggcagctgttttaacagcagcgacgttaatccggttccgttatccaatttgaaggtgaaatgaaccgtcggtttgcgcagatccgcatcaattaaaagcacttttttcccctgctgtgcaaatacgacggcaaggttggccgcggttgtcgattttccttcttccggaccggcggatgtgatcaaaagggacttcacctccgtatcaacggaagaaaattcaatgtttgtgcggatcgtgcgatattgttctgagttgatggatttcggctcagacatcgcaatcacgcttcgttttccgggtttgtcttttttacgcgtcaacatgtccgcctcccgcttgtttggtttccgccatcctcacatttttggcaacgctgtcttttgtactgattgaagtaaccgttcccaggatcgggatgccgagcagcgcttccagctgttcttccgatttgatcgtattatccagatgttccagcaaaaaggcgagaccgattccgcccaaaagtccggcggcaaacgcaatcgcgatgttcagcttacggttaggctctgccggtgactggctgtccgacgcttcggcctttgaaaggatgctgacattatcaacgttcatgatggcggtgatcttgtcctgaaaaacggatgcaaccgcatttgccataacggccgcccgcttagcatccgtatcccgaacggcaatcgtcacgacttgtgaatcctgctcgctggataccgtgattttcgattccagctctttcgaagtcatggacagatgcagctgtttaatcacctcatcgaggatgaccgggcttttgatgatgacattatacgtgttgattaattggaggttggtttgaacgtcattgaattggacttctttttgattgtttttggattggctgaccaaaatttgagttgagttttcatagaccggcgtaagagcgaagaaactgatgagaccgcctgcggaagatgccgccgcggtaataataagtataaacagcagacgctttctcagtattgcgaatatttcctttatgcttgcagattctcccatataacctccatatcactttccgtgtattcccattccctccaatgatcttttccaattacgattatacagctttgaactgtcatttctaaccttttcaaatgacaaaattcgacaaaaacagacaatcacttcaatccgatttatatttgtaagcgctttaaatgctggtgtcacaggaagattaaaaaatcccgcggccaagagcctgcgggattttatgttgcatatccatttttaatataagaaatcaaattctcaagcatttcttttgtggtcatctcagaggactgctcaccgatgtcgtgcgcatgcattaaaatcttcagaaactcctcttgatctaacttcgttttcttcatcattcgtttcctttcggcttccattaaattgaaaacaagattattatatgctgtcgggtgctgttttgcaatctctaatacatcattcgacacattcgggtttttatgtccttttttaggaaaaactttttccgggccatgtgttgcgatataatagaggaattggaatctttttattttgtgactcgttaggagcgataatcatgcttcaggatatgattgctaaagaagatgtgctcgcagcggctgaacagcttaaagaacttcttccttacaatgaagacaatgttcagctgatgaagaaagcactcattttatatcggcaggattccgtctatcgtatacaggttcaaaccccgacagagatttccgcatatgtgcaggatgttgtgcctgtaagggtcacgctgaacttatttttcatggtgaaaagcggctgcgcatgcccgtctgaggcgatctgccgccacgtgctcgccgtttttctttacgtatatgcccaattcgagcgggtcggtacctttaccgaacattggctggaaagagaaaagcttgaggaaagcagggagcttgtccgccggcagtttcaggaaaaagtgctgccgaatgaagagtcgctgtcaagctggctcgctttttttgattcggaattctcgctgtgggaggcgcggacgccggccggaagccagacgatgcagggcctttattacggctatctgtcagcgctcaaaaaacacgccccgaaaaaacccgagcttaaaagcttatatcagattcattcggcgcttgccgtctggcttcacatgttcactttgattgagtcaggcagattggatgccgaaaaagattattacagcattaatccatacgtggaacagctgatggatacgatttattcctccattgacagactgaaaacgtacgccttgtctttttcactcgatccttttttagaccggacgcctccggtgctccgcagactgcttgtgaaagaagagctttttcaatacgaacgcctccgggtattcggtgaaatgtggagcgcgcttttgaaccggccgaaatgggtcgcgcgtgaacaggagattctcgaacaggaaagcgggcgccgtttttcgccggaagtgcggttcggacggcttcatctggcctttttgcaaaaagatgatgaagcggtctttgaagatatatcccgcttccctcctgaagcgctgccgtacacctttcaatggctcggtgaactcaccgcgaaaaaagactggaaacggctgaaagcatggtatggccggatcgaaccgcttgccgtgaactatacgaagcttgataagccgtttaaagaaatgcgcgacatcatcggagagctgtttgcgctgttggcggattatgcgcggcactcacgggatgatcagctgtttgaacggtttgcttccggctgccttccctatacctttaccgaatacagccagtacctgtacgaaaaacggcggtacgcggaatgggtggagattcacagcctcgtcggtttttccgtctgggaaatcgaaaaggacatcctgaaggaaattgccgccagtgatccggaagcgctcatcccctcctatcaccgggctgcggccttttttatcgaccaaaaaaaccgcagcgcctataaagaggctgcgcgtcatctgaaaaaactgcggacgctttataaaaaggcaaaaaaacagcaggtttgggagcggtatatcagccggctgagcgcaagctacaagaggctgcgcgcccttcaagaagaattgcagaaaggaaagttgattgatggcgagtcttaaggaaattttcattcatgttgaacaaatggaagattggacatttacgctgtcaagccatgatgagaaggagcagccgcttactctcagtcagatgaagactcatttgttccaatggcatgagtccaccttttacggaacgtttcttgaagacgtcagcttcatcggcactccggccgttctgctcagcccttggatgaccgtcgagctgcttggaaaaaactcgttcaattcattcagcaccgtgcagctgacaaaggaaacggaaccgttaatcgaagcggcttcgacgatatacgaatttattgccgacggcgattttcttccggattatgacgcatggcaaaatggtgtcctgcgcttcaaagaccgcgagcttttgcttgaaggctttacggcagactggttctcagccgcggtacaggactacattcagtacaatgatgacctgctggaaaaatggcggcggatcgaaacccgttcgccggccgttcatacgtttaaaggctcctttttggatgaagatgattttctcgagggaatcggttggcatgacgatctgacgccgtttaccgtcgggctccgattaaacgagcctgatttcgacggtgacgactggaaaatcgagatgtttttacgtgagaaaaaaaccggctccatcacctttttcgacggattgaagggtctgaaaaaagcgtggcaggcatacagcggaaaaatcgcgcgcgaacaggaccgcttccgcagaacggttccctggctttcgtttgattcaggaacgacgctgatctctgaagaagaggcttggatcttcttatcggaagcgagtgagacgcttgtcgatatgggtgtggagattcttctcccatcatggtggcagattgtccgggacagcaatatgatgctcaaggcgaaagtgtcatcctccccgcggggcgagtccttcgtcggcatgaacgctctgcttgatttcaactggagattcgccacaaacggaattgagctgacagaggatgaattcaatgagcttgtcgcaaacaacagacgtctcgtcaacatccgcggccaatgggtgaaaattgatccgcaatttattaaacagatgaaaatactgatggaaaaagcggaatctgagggcctccacatgtccgacgtgctggcgcgcgaactgatggatcacggggaaaacggagccgaggacacggacatcattgactcatcggcatttgccgggatcaagatcgaattatcaaagcatctcagaagcctgatccgcaaactgacggatgccggggatctgccggagcatgaagtcagcgccgcgtttcagggccagctccgcccttatcagatgtacggcatgaactggcttctgtttttacgggaaaacggcttcggcgcctgtctcgcagatgacatgggacttggaaagacgattcagatgatcgcttattttctccatgtgaaggaaagcggccggcaaaaagcgcctgccttaatcattgcgccgacatcggtgctcggcaactggcagcgtgagctccagaccttcgcgccgcagctgaaggccgtgcttcattacggcccccgcaggccgaagggcgaagcatttgtcccggcctatcaggacgcggatgtcgttcttacttcttacggcctctcgcacgctgatcaggaagagctttcttccgtgacatggagcaccatctgccttgatgaagcgcaaaatattaaaaacgcgcatacgaagcagtcccgcgcaatcagaaagctgaaaggcgtccatcatattgcgctgagcggaacaccgatggaaaaccgcctgacagagctttggtcgatctttgattttatgaacaaaggctatctcggcagtctgaccggctttcataaaagctatgtgctgccgattgaaaaagaccgtgacgaaaaaagaatcaaccagcttcagcagttaatccggccgtttttactgcgccggacaaaacgggatgaagaagtggcgcttaatcttcctgacaagctggaacaaaaagagtttatcccgctctcagccgaacaggcatccctttatgaacagcttgtcaaagatacatttgaacatatggcttctctgaccgggatgcagcggaaagcgctgattctgagcatgctcggccgcttgaagcaaatatgcgaccatcctgcgctctatttgaaggaagaacagacagagctgttaaacgggagatccgtcaaactggaaaagctgcttgacttaatggcggcgatccgcggacaaggggaaagctgcctcattttcacccaatacattcagatgggcaacatgatgaagcgcctcctggaaaaaacattcggagaaccggttcagtttttaaacggaagcctgtccaagcaggaacgcgattctctcgtcgaacggttccagaagaaagaatacccgacgctgattttgtcactgaaagcgggcggaaccggcctgaatctgacggctgccaatcatgtcattcactatgacaggtggtggaatccggcggtggaaaaccaggcgaccgaccgcgcctaccgaatcggccaggaacggttcgtccacgttcacaaactcattacgacgggaacgattgaagaaaaaattgatgccatgctcgaaacgaaacaaactttgaacgatcagattatccaaagtgaaaattggattaccgagctgtcatccgatgagcttgaagaattattcaccctcagcgcatcggcgcaatcacattaaacgcaaaaagaccggctctctcgggaagagccggtcttttatgtcgtccttactgttacgccgcatttgccatgaatgcgtcacgccagtcatgaacagtatcgccatacctttcacagtaaattcctgatcatatacgcaacgccgttttgatcatttgtcaatgtaacggcatcagcgatctctttaatatcttctctcgcattccccatcgctatgccttttccggccgcctgaagcattgaatagtcatttaagctgtcaccgaccgcggcggtttcagccatcggaatgccgagcttttgcgccagccgtttgagcgcctgccctttagaggcgtttcgagacgccagttcgaagttgtgatcggcagagctgacaagggtgagatctttctgaccgctgaatcggtcccagcccgctttcagcttccgctcatcaaacgaaaatccgagaatattataaaaatccagatgctcttctttctcaaagagctcacggtatgaatgaatgtaagcaaagccggactggctgtattgcactgaagccgcctgttccaaaacagaaagatcggtttccggattggcgcttttcacccggtccatttcgatatcgagcagctgcctgccggtttcaggcgtatagatggctttgtttgtaaacacctcataataatattgattctcttcaagccatgacaaaatgccgcgggctcttgattcttcaatcgcttcacagtggtacaggctgccgtcaggagcatgaatgacggctccgtttgcgctgataatccatgtttttatgccgagcggttcgaatatggagtgcacatcaaaatgcgcgcgtcccgtggaaaccacgatttcaattcccgcttgccgggcttcccttaaagcccgcttgttttcatcgcttacttgatgactgctgttcagcagtgtgccgtccagatctatggcaatcagtttcacatgtcctcatcctcttcttcagattcagttacaagcaattctacgccgtgccggtcgagcagatcgcaaaaatcctgatcaggcagccgatcggtaatcagcaggtcaacctcgtgcaggtctgcatactgataaaaactcgtacggccaagcttcgagtgatcactcagcgcaatcacctgttcagcctgtcggatcattttacgctttaccatgccgtcttcttcatgcggaatcgtcaggccgttttccgagatgccgacaacgccgatcagcaccttatcagcgtgataatcccccagtttttctacaacggaagccccgtataaaaaccggtgttccttctggagctttccgccgagcaggtgaatatcaattccctcttttgcggaaaggatatcggcctgattgatcgaatttgtaataacagtgcagccggtgacatttaaatgctccgcgcaggcctgcacggttgtcgaggtgtccaggatgatccggtcccctttatggatcagggatgcggccagcttgccgattttgtttttctcttcagaaacggttttcagccggcccgaatagcctggaacttcctgattcactgacggcagaatcgcgccgccccgtgttctgataatggcccctcgctctttcagctttacaaggtcccttcttgcggtatctcttgaaatatgaagcagcgaacatatctgttctgcggtgatccgccggtgctgtttcaaatattccattatcgcaatcagtctttcttcttgatacacgtcctcattcccttttttcgtcacttatctgtaagtaattataagtttttatcccaatatattcaatgtttttaagtatttataagcaaaatcacttctttttaaccatttttcagcttccgcacaaaaaaaccagtctttcgactggcgagtgggaaggaggtattgcggggcccgctgaaaggcgggaaatcgaggaaaaaagcatgctattcagccagcggctctttccgtttctgatccataaaccgaacggtatcagccatgacctcggtcacataaacttttacgccgtctgtcttttcatagcttctcgtctggattctgccgcttacaccgaccattgaccctttttggcagtacaatgccgtgttttcagcgttttttctccagatggtgcagttgacgaagtcggttccggtttcacccgacgcgcttttaaaattgcggtttaccgccaacgtaatatgcgcgacgggaatgcccgctgatgtaaaacggagctccggatctttcgtcagccggccgacaagcataacgtggttaaacaagccgtatcctcctctctttttcgaggctggcttcattgtagtacaagggctcatgaaagcaaaaagcggaaaaagccgttatccgtttaggctgcttttatgtttttgtttttctttctgataaaaaaaacttttgtttttgaccgcttatgtaatatgtatttttgagcagccgcgagaaaagtttcgttttgagccagtctttctcaaacatgcggacaaactttccgccgtcccatgcgaaccagtaaaaactcagctttttatcagtcagtgaaagctgaattttatactgttccatgcggtcttttgtttcatataaaaagacgacatttccccttctgttaagatgcacctcacaatcttcctttttgcataccaagtaggaatgatcgtcttttcgccttgaaccgtcttctatatagatttccttcaggcgcaattgattcataagcatctctccatgaccatattcttttacattataatgaaaaaatagaaatgattaaatgttgaccgcctacaaaaatgatgaagcatgtcttacagcattttcccgggaaaaatgatatgtgttataataaatgaacgaaaaacatggacaacaggggtgaaaataagagatgaaaacctttaaactggttgatctgaatgtggaacgtttagataaagacgatcagccgattgaacagtttccccttttagacggattgattatcaacaaagaggacggagaaaatcactggttaattgaagcactggtcccggccgaacacttttctttttttgacatgctgatgaaaagccagaaagaagcgaaggtgtttgtaacgattacgaaaaaaagcaaccgccccgcccagctgacgggaagcatcaaaaatatcgtggagctggaaaagagtatacaagttttaatttacggtcaaatggtgtcaagaaaccaccccggatcagaaagcattctggagtcgctcgtaaaagaaggctactcgggcagccggctgattgaagcgtttaaacaaaaattataatcataaaaaaggccggacgttaatcatccagccttttttgtgccctagtcattgtgaggagcccgctgtttcagcagatctctgatttcagtcagcagttctgtctgctgatctgtgtcttctgcttcttcagcctcttcttctgcttcttttttacgtctcagcttgcctattgtgcggatcacgataaagatagaaaatgaaataatgaagaagttcacaatcgtttgaatgaagcttccgtacttgatatgggcatcgccgaatgtcaccgccagccctgaaaaatcaagaccgccaagaagcaggccgacaagcggcatgatgatgtcttcaacgagcgacgtcacaattttgccgaaagcgccgccgatgacgacaccgattgccagatccatgatattgccccgcatcgcaaagcttttaaattctgaccacattacattcacccctttctatacaaaatgggcttttttataagcccatctgtttgtttttattctccgagcgcaaaggttaattcagcttcacacacgagctcgccgtcaactttggcaacgccttttccgcgtccgatcgtaccgcgtgcacgtgtaatgtccacttcaagctccagcttgtcacccggttttacctgctttttgaaacggcagttatcaatccccgcaaaaaacgcgagtctgccccggttttcttctttaatcagcatcgccacagctccgacctgcgccaaagcctctacgattaatacgcccggcataacagggtattcaggaaaatggccgttaaaaaaatcttcattcgccgtcacatttttatatcccgccgcccgttttccttcttcgacttccgtaattctgtctaccagaagaaacggatagcgatggggaataatttctttaatttgctgagtatcaagcattctcttgacatctccttcatcgacaatagtatgtatagaaggtataagtggtaaccaatctgtacatttggaagtatattatgaatcaatttctttttcaaccgcgctgtaaactgtaaccagctggcaatgagcctcgtccattaatgtgttatgataaataaagatttttaccctatgcaaagaggttggaagatgattgctaagtttactgaaaaacgcacgctggtgatgctgaatgagtggtatgacgccatgggaaaacgccaattcgatctagcccgttcccttcacgaacaaatcaatcagcatctccccaaattacaaaagaatgcaaagctcaatctcagatatcagctgtttttcgcacggtttcagctgctgtttgagaaaaaagacggtctgactaaattgttctgcgagctgaagcggcgcaaagatgagatggatcatgaattaacttattatttctattttttcaaagggttattccatatggtgaatggcgctccgaaccgtgctgtctgccgctttaaagaagctgaacagtacctgccggccattcaggaccgtttcgaagccgctgaattttattataaaacagcgggtgcatattacatgatgaagtcgcctgcgctctccattcaatatgtcaataaagcgctggagatctatcaaggtgaattcggctacatcaaaaaaacactcagctgccggctgcttctcgccgtgaattacatagacgaggcacgctatgaagacgcagaacagctctttaatgaatccataaagataacggaccggatcaatgacaataacctgctgtgccacgcctattataattttggttttttaaagaccgcccagaaaaaagataaagaggccctccctttttacaaaaaggtattgggcaatcagcgtttcgagaaagagtctcccgtttcctacctgcattgtgtatacgaagcggtcagagcactttttaaaaccggatatgccgccgaaggacaaaccgtgctgcagaaaggtttatacatatctgaaaaagtgcagaacaagattatgaaattgaagctgaccgcgctcaacatactgtacaccgctcaggaggacccgtacgaccggttgcagaagctcgtgctggagctgcagaaaattgaagcgtgggtggatttggaagtgctgcttcaggatattactgattactacaaaaaaaagggcgattttgagaaagccgcattttttatcatgcgcggctgatcaaaacgccccttcttttatctgactgagttgattaagcccagcatttggtctcccaatgtaatcgtgcggctgttcagctgataggaacgctgagacacgattaggtcggtcatttcttttgacatatcgacatttgaactttcaagcgcgccctgctccatgccgattgcctgccggtttgcgccggtaagctcttcaatcgctgaagcacccgctccgtttacggaaaacagattatccccttccgcatgaagggcctgaggattattgacattgacgatgccgagattaaacgtctgcgaacgggttcctgcctggtctgaagcagtcagcgttccggttttgctgattttcagctgattcagcgaactgtcaatttgtatgggctggccgttctcatcgagaattggattgcctcccgctgtcatcagctgaagcagccggtcatttccgccgaccggcttgagggaaagtgagccgtcccttgtatacatccgccgtccgtccgcttctgcctgaagatattgataaggtgaggtgaacgcgatatcaaggtcacggtcggtttttttgatgcttccctgccctgagtccagctgcggagtcatgaccgtcccggcgccgagacgcaggccgggcggcgttttccgcatgttcggcgaattttcctttttgtcatctatatggtcatactgctgtctgatcagctcggaaaagcgggagtccctcgctttatagcctgtcgtatcactgtttgaaaggttgctgctgactgtatccatctgctgctgaagctgatttaaggctgttgaagccgtcagcattgatctgagcatcataattgaacgtcccccattttgttacactttgccgatttcatttgcggctttatccatgcttttatcgtaagcctgaatgactttctgattggcttcaaatgatctgtatgcttccgtcatttctgtatacgtgctcgtcacgtccacattcgaaagctccgagacgccttgctttaatgaatacgagacctggggattcgccgccgcgctcggcagttcagagccgtcggccgtgctgtataggtcattgccgtcccgtttcagattgcgcacgtcttcttccatcctgatgtcaatctgccccgccggccggccgtttgtcgtgaccgttccgttttctgatacggtgaatttttcattgtcgactgtaatcggctgtccgtttgttgataaaacaaggtttccgtttatcgtaagctgattgttttcatttaatgagaaagtgctgctttttgaatagcggacgccgcccgcagtctgcacgggataaaacagctcggcgttttcattcgtttcggcattcttgggaacctgattctccataagcgcgatatcggtcggctgatcggtcgttttcaggcttccctgcgtaaacaacggtttcagctcctgcatgtatacacctgtgttgacggaaccgattttcgtttttttgtcgccttctattcggctcagaagcatctcgggaaaggcgcggattgaaccttgatcctctttgtatcctgacgtattcgcgtttgcgatgttatttgacagcatttccgttcttctctgctgtgtaatcattgcggacgttgcggtatataatccttttaacaagtcttccacctctgaaatagcattatttccagttgcctaaccggaacgtttgttctataatgaaaatcagcattttttcttattatcggatttacattcccgttcgtgaagggtttgacagaaaaaaacccattctttttcagaatgaggttttatcatcagctcagtttgcgttttggaagcttgtccatgttatccagcatgacgccggttccgaccgcaacacaatccatcgggttctcagcgacaagaacgggcaccctcagctcttcggcaagaagctggtcaagcccgtttaacagcgctcccccgccggtaatgataacgccgcggtcgatgatgtcagcggacaattcaggcggtgttctttcaagaacctgcttggcggcctgcacaatgacggcaactgattcacgaagggcttcttccacttctttgctgtttactgtaatcgttctcggcagaccggaaaccatgtcacggccgcggatggtgatttcttcatgacgtgcgtctgggaaaaccgttgcgaccttcaccttaatatcttcagcggtacgttcaccgatcagcagcttatactcgcgtttgatataatttaagatttccatgtcaaacttgtccccagccatcttaatagaagaggaggtgacaatatcgcccatagaaataactgcgatatctgtcgtaccgcctccgatgtcaacaaccatgttaccgctcggctggaagatttccatacccgcgccgatagcggcaactttcggttcttcttcaaggtacacatgctttccgccgcttttttcagctgcttctttaatcgctttttgctcaacggacgtaatattcgtcgggcagcagatcagcatgcgcggttttgagaaaagtccttttacattcagcttattaatgaaatgtttcagcatggcttcagttacttcgaagtctgcgattacgccgtctttcagcggacggatcgcaacaatattcccaggtgtacgtccaaccattcgtctggcttcttcaccgacagccagcactttgccgctgtttttatcaagtgccacaacggaaggctcattcagaacaattccttttccttttacatggatcagtacatttgcagtaccgaggtcaattccaatatcccttgcaaacatctatttatatcctccttgatatctgtttcacagtaaaatatccacattgtgccctaattatatatattatcataatttatcaaaaaaaagctgctgaacgatataagttcttgacaaaattttgcggatattcgcgaaaccgcccggaggagaaaaaagggcccggcagacgtcaggcgctacggctgctgaacgggctccccttcaagaatttcatccttcttgtactttaatttcgtcgcctcgccccccttaaatgtctgatggatttatgataatcgagtatttcttttacttcattcgccaagtcaggattgatttcaggcaggcgttctgtcagatctttgtgtacggtacttttggaaacaccaaactctttcgcaatgacacgaacggtttttttcgtctccacgatatacttaccaatcttgattgttcgctctttgatgtaatcgtgcacaccactcgacctccccagttggatgtgagaagtgtgaaatgagatccgtattctgtaacagattcactgatgatgcagcttcttcgttgtccgattatataagaaggttttagaaatatgcccacgatccctcacctcaaacactctctttgataggtttgtaacagtgtattagcaatgaattgggaatatgctaaaaactcaataaggacaaggggcgggtcataattttctgctttttgaacagggggtttacatccgcgcgatcctgctgtagaatgaaacagcacaattagttacttaggtaagttttttgaaaaggagaacggaaatgatccacgtcaacagacgcctcattcatcaaatcaatcaatgcgcccgcctgattacgaagaaagccaatgaacggctggaaccattcggcctgtactcctctcaatggtcaatcctatattgcttaaaaacgttcggaccgatgacccaaaaagaaatctggtcctatctgaacgtagaggcgccgaccgttaccagaacgatcaaacgccttgaagaaaacggctggattcagcgggaacagggagaagacaagcgggaaaagctcgtcgtcctgacgaaggaagctgaattgaaatacaacagcatcaatcaagagatgctgaagttcgaggaagacatgcttgcggatttccaagatggagataaggaagctttttctgagtttctgaatgtgtttttaacgaaataaaaaagaaagggaagtgctgtacttttgagtaaatctgactcgatctggaccaaagattttattatggtcgtactcgtgaatttatttgtctttgtgttcttttatacatttttggccgtgctgcctatctatatgattcaggagcttggcggcagtgaatcacaaggagggcttttgatcagcctgttcctgttatctgctattatcacccgtcctttttcaggggcaattattgaacggttcggcaagaaaagaatgacgattgtatctctggcgctgttcgccctgtcttcttatctgtatttgccgatacacaatttctatctgctgctcggactgcgttttttccaaggcatctggttcagcattttaacgacggtcacgggcgcaattgccgctgaccttattcccgccaagcggcgcggcgaggggctcggttatttcgcgatgtctatgaaccttgccatggcgatcggtccgtttctcggactgagccttgtgaaagtcatatcgttcccggttttctttacgctttttgccgtatttgtttctttaggcttactgattgcttttatgattcgtgtgccggatcaaaacaacagcggaacgactgtcttccgtttttctttctccgacatgtttgaaaaaggcgcgcttaaaatcgcgattgtcgggttgtccatttctttctgttattcaagtgtgacttcatatttatccgtttatgcaaagacgatccacctgttggatgtcagcggctatttcttcgtctgtttcgccgtgacgatgatggccgcccgtcctttcacaggaaagctgtttgacagagtggggccgggaatcgtcatctatccgtcgattatcgtgttctccgcggggctttgcatgctggcgatgacaaacagcgccctcatgcttctcttgtccggtgccgtaatcggtctcggatacggctctatcgtaccgtgtatgcagacgctggcgattcagaattcgcccggacaccgttcaggctttgcgacggctaccttcttcactttctttgacagcgggattgccggcgggtcatatgtattcggcctcttcgtcgcttcggccggattccattcgatttatctggcagcggggctgttcgtcctgattgctttgctcctgtatggctggagccagaaaaaaagaacgccgcttgaagcggacggaaacgtttcaatcgcagactgatatgacaaaaagccggggggcagcccccggctttttttattcggccgctctttcccgcacgattcgcccctccgcttttacataaggaggatgaatgtacataagcgccgtataaccgagacatgacaaaatgacacccgcaaaccaggaaatatcatagatgccggcgaacgccgggacgtacatcccgattaaagaaataaacgcgccgagaaaggtcgcggcaaaggcccggtaattatagcctttgtaataagtgtactgtccggtttccgaataaaggtcttcaactgagagctgcctttttctgatgataaaataatcagccatcatcaccccggccaccggtccgagcatcccgccgatgagtccgagaaacgcatatacattcgtggcgctctccatcagcttccacggtattgtgaacagagccaaaacggcggtcaaataccctccccttctgaatgtaatatacttcggcaggacattcgccaagtcataggccggtgacacgatgtttgccgccacgttaaccgagacggcggcgatgcaaagtgtgatgaccgaaagagcgatgacgaaaggattatcaaaccgggccaaaatctccaccacatcccaaatcggttctccgaatgctacctgtgatccggatgtcaccgtgatgcttgcaaacgcaaacagcgcaaatgttcccggcagcccgtaaaactggccgcgaatctgttctttttgcgacgcggcgaaccgggtgaagtcagggatattcaggatcagcgtcgcccatattccgataattcccgtcactccggcggcgaacggccaaaacgtttcagaaaaggtatggaactttcccggctgtgagtaaatcggaccgagcccgccggcaatatctatcgcccaccagaccatgccgccgaagacgagatatacaagcgggcccgcccacacttcaaattttttgatcgattccatgccgtgccgcagcacaagcagatgaatcccccaaaagaaaatgaacgacagaaagcccggcagatgaagcccgaatatattccaatctccgccgagactcccccagccaggccatatgttcaaaagcagaatgtgtaaagccgtgctcccggcaaatgtttgaattccgagccacatgatggctgtaaacgccctgagaagcgccggaatgttagcgccgtatattccgtaagaggccctgataatgaccggaaaaggcaggccgtatttcgttccggcatggccgttcaaggccaaagcggcgaacaaaatcagtgacgccgtcacgataatggcgagcacctgccacggagaaaggccgatcgcaatgagcccgcccacagtcgcgtaggtcgggatattatgaatacaccccatccagatggatgcaaaattcactgctttccatgtccgttcgccgtcttctaaaggcagtaaatctttgttgcttagccgatcactcattgtttttttcattttctccctcccgcatgtacgttttccttacatcacatgtgaaaaaatataactgaaaattccgtaaataacattggttgctgtcgacaataatcgttttgttttttgagcacattacacaaaaaaagagacggggagagcccgtctcttttttttgcgcctgttaagaggcttttttgaggagaaccgaaaaccggaacgccatcaaaaggcttacggcgccgacaacgataagaatcgtcccaagcatatgaaaatggccggcggtaatttctttcccgaaaagaatgcccaaaatgacagaagacaaaatcgaaccgagatacctgcaggtctgaaacaggccggacgttgttccgaccatgtcggcggggctcgttttcagcatggccgcctgaaacgtgacatttccgaagccgtagccgacacccagcacggacaggatcagcccttttcctatcatgggcgcctgaaggaagaaaaacgttaacagcaccgctccgagcgcggtcaggcaggttccggcaacaatcggctgaagaagcccttttttatctatccattttccggtcaaaggcgacaccagaatactcatgcccgacataaacagcataatcaatccgcttgtctgaacggacaaatgcatttcatcctgaaaatagctcggaagcccgaaaaagatgcagtaaaagaatatattcagcaaaataaattgaatatacaccgacgatagtttccgatgcgttttaaacagcctgacatcaataaacggcttctccgttttcagctcgcgccagataaacagcccgacaaacaaaagcccgaatacgccttctgtatagtgaggcttcgtactgaaggacaataaaaacgacaggagaaggataatcgctccggcaaacagaagtatcccgatcgtatcaagctggcggagcacgcctttcaagccgccgatctcgcgtttttcatctttcggaaacatatacattccgagaaaaaagctgagaatgataaacggcagattgacgaaaaagatcgccggccaccctccccaaacgatcagaaaaccgccgagagtcggaccgagcgccgtcatggctgatgcaaagattgacaggacggccagcgccgaagcctgcttctcctgtatatttgaacggatcaatccgacgccggacggatatatcgcgctgcttccgatcgattgaaaaagccgcatgatcagcaatgtcataaaagtcggcgcaaacggcgcgccgaccgccgagacggcaacaagcagaagcccgatcaaaaacagcttcttcctgccgagcatatcaccgagcttcccagtaacaggctgcgccaccgcgctggcaagataaaaggacgatatcagccaggacaccgttgtaaacgacaggtgaaattcatgctgaatactgtgaagcgcaagagaaatcatcgacgagttcaatgggttcagcatcgtccccgaagccacggccgtcaaaaacaggacgcggctttttttggagattgtcattttgtctgtgcgataaattcttccgtcgtccggcttctgccgattttcgggaagataaacttgagtgtcgcttcatgctgttcatcactgaatgtcgccatcgcgtcagttacgaaaacttgctgatatccgagctgaaaagcttcccgcgccgtgctttccacaccgatgtttgtcgcaatcccgcataacacaatcgtgtcgattccccgtcttctgagctgaaggtccaggtccgtgccgaaaaacgcgccccactgccgttttgttaccgtataatcgttttctttcactccgatttcaggcacaaattcagcccaatccgccggcggagccgaatggcccgccgcctcttcatccgtcagcggcttcagcgcatccgctccgtcatgaaaatccacgttcacaaagctgataaatccgcctttttcccggaacacatcaattaattttttcgcgttcggcacaacggtaccgcttttatccatcggcacaatacctttttgtaaatcaataatgaccaaagccgttttttcaaattgcagattcaatgatgttgtcataatgattcctcctgatgcagttagtgtttctcaccccgtttattttactctttcccggacaggatttcttccgccatgctccggcgctctttttatggatataaagtcgcatgacacccctttgaaaaagcgacattatgaacgcaaaaaaccatgttagataaccttacacgaaaatgttttatcgttcttttttctctataataatgaattaatcacgattacattttgaatgagacggaggaatacaacatgcagatgggcgatacagtatttatgttcttttgcgctttactcgtgtggctgatgacccccgggctggctttgttttacggcggaatggtaaaaagcaaaaacgtgctcagcacggcgatgcacagtttttcttccctcgccatcgtatccgtcgtttgggttttgtacggatattcacttgcttttgcccccgggaatacatggcttggcgggattgaatgggccgggctgaagggggtcggctttgaacccggaagttacagtgatacgatcccgcattcattattcatgatgttccaaatgacgtttgccgtactgacgacggccattatttccggagcatttgctgaacgcatgagattcagtgcttttcttgtattttcctttttgtgggcttccctcgtatatacgcccgttgcgcattgggtatggggcggcggctggatcggccaaatgggcgctcttgacttcgcaggcggaaacgtcgtccacatttcttccggggtcgccgggctcgtgctggcgattgtgctcgggaaacgcaaggacggcacggcggcttcgcctcacaacttaatttacacgttcttgggcggggcgctcatttggttcggatggttcggcttcaatgtcggcagcgccctcacgcttgacagtatcgcgatgtttgccttcattaacacaaacaccgcggctgcggccggaattatcggctggattttaatcgaatggatgctgaacaaaaaaccgaccatgctgggtgctgtatcaggcgctattgccgggcttgtcgccattacgccggctgccgggttcgttacgccgttctcttccatcgtaatcggcttcatcggcgggcttgtctgcttctggggcgtgtattggcttaaaaagactttcggatacgatgatgcgcttgacgctttcggcctgcatggaatcggcgggacatggggcggcatcgcgaccggtttattcgccaccacttccgtcaatgacggcggggcaaacgggctgttttacggcgatccgggactgctctggaagcagattgcagccattgcggcaacctacgtatttgtatttattgtcactttcgttatcattaaaattgtaggtctgttcattcccctccgcgccagcgaagaagaagagtcacttgggcttgatttaacgatgcacggggaaaaagcatatcaggacttataaagtgaggagtggcttagatgagcggtcaaatgttcaaggtagaaatcgttacgcgtccggctaagtttgaaacattaaaacaggaactcggtaaaatcggagtcacatcgctgaccttctccaacgtacacggctgcggccttcaaaaagctcacaccgaactgtaccgcggagtcaaaattgaaagcaatgtgtatgaacggctgaaagtggaaatcgttgtcagcaaagtccccgttgatcaagtcgtggaaacggcaaaaaaagtgctgaaaacgggagagcccggagacggcaaaatattcgtctatgaaatcggaaacacgattaatatccgcaccggagaagaaggaccaggagctttataaacagacagaacgcccggagacagaaatatcccgggcgttttttctggcttcattaaaaagaagaagcctttttttcatgcggggcaggacgcttatgccgtacggtttgttttttcgcatatgtactaatattgaccagtatgccgcacaaaaacagcgtcataatcaatgaagaaccgccataactgataaacggaagcggcacacccgtaaccgggaggagtccgctcatcgctcccaaattcaagacaacctgaaacatcaattgaaacgtaattccgatggcaagaagcttcccgaacgggtcatcagcccgcacggccgtttttacgccgagaagcattaacgcaaaatataatcccaaaacgatcagaacaccgaatatccccagctcttcgctgatcacggccataatgaaatcggtatgcgcctcaggcagatagttcattttttcaacactgtttccaagccctcttccgaaaaacccgcctccggaaatagcaaaataggattgaatcagctgatagccgtccccgttcgcgtcaccaaacggattggtaaaggaaacgaggcgcttcacacgataggaagcagaaaatgcgagataaacaacccccgacaccgccgtcgcgccgagcacgaacagatggcgctttttcaagccggcacataataaaatcgacccgcacgccgccagtattaaggaagccgtccctaaatcaggctccgccaatgtcagcagaaaagcggtccccaaaatcactaaaggcggcagaacccctttcacaaattgatgaatgtacggctgctttttcgtataaatcgaagcgaaatacaaaatcatggcgatcttcgccaattcagacggctgtacgacaagcgggcccgctcccagccacctgcgggaaaaattccgctccagcccgattcccggtatcaatacgagcagcagcaataccagcgaaccgaccacaaacagcggtacaagccgcgcataccgcttatacggcagacaggcggcaaatagaaataagcataatccgatcagtaaagaggcactttgtttatggaagaaataggatggatctccgtaccgctgagaccccatcacatcactggcgctgtacaccattaacaagccgaatccgcaaagcagcataatgacaaacacaagcggcagatcggcgtttttcaaacgtttcagcaacggacaaaactccttcggctattcttttcccgcatacttgacgcacagtaatacagtcacgtttcattctgtttacttttttatgattatttttaataccaattgtgtctcatagaaaaaagcattacactgttcatataaaataaagataaaaggtgatatttgtgaattacgaactatttaaagcgatcaatggtttgtcgcaccatagtgccattctcgactctatcatggtatttataacggaatacgccatttacgcctacgcccttttcctgcttgccatgtggctgttcggaagcacaaaaggcagacaaaacgccctgtacgcgggcttcacgggtgttgcggcgcttatcatcaactacctcatcacgaaagtctatgtcgagccgcgcccctttgtcgagcatacggttcatacactgatccctcatgccgcggatgcttcatttccgagtgaccatacgacaggcgctttggcgatttcaattgcgattctgttccgcaacaaaaaactcggctggccgcttgtgattttcggccttttgaccggcttctcaagaatttgggtcggccatcattatccgatcgatgtgctcggaagcattatcgtttccctcattgtcggattcctgctgttcagattttcaaatgtgcttcgtccgattgtcgatctgatcgtgcgaatctatgaaagtatcgttcataaaagcaaatcgacaaaccataatatataaaaaaaagccggcgtctgtcacagactgccggtttttgtatgtttgtacgggcgccctgccgcacaactccttcagctgcagccaaggcgcgttccgttgtctgccttggccacgaaaaacccggcatcatatcaggaataacagcaagatataagtgagagaaaaacatcatttgtttataataaaagggattaagttttgcataaatattctagtagaaggggctagtttaaaatgagagaagaaaatcaatttaaaaatgaaaccttaggtcaaagaaaaaggagagagattagagaaaaacaacgagccagagagaagtctcctgaagctatagagaaaaagaagagattgaaacaggaagaactgtattcgatgaataatgtacgacaaacacttagcaagagtagcgaaaaaacaagaaaaagattcgcacaaaaaggaaagtatacaacaggtactagtaaggaacaaaaaaaatgggaacaaaaaagaaaagataagtacaatcaacgagtgtggaaaggatggagggaaaaagatgatgatcaagcggctcctgttactacatacactatagaagaattagagaaactaaaataatgacttgcggaagctgtagtagtggtgtacttctgattgcttcgtaaaaatggagcattctcacttttttcctttgtaaaacacagaatacagcaatgccgagactgtcaatcagcacatcgcggaggcatccgtttctgccgaaaaagagctggacgatttctgtcaggaaagcggcggccaatgcatacagcaccgccctcttcatgcgcctgcgccccctgaaaaacaaataggcgagcacaaaaaatgaaaacgcgtgcccgagcttttgaatcgccgcttccggtatggcgagctccgccatatcgaacacaaagaaaccggacacatccggatgggacgtgaaacggaaggacaccgtctgcgacacaatcatgtcgtgaaagctttcagtcaaagcagaaacgaaaacaaagacgagccacccggccgccagacatttattcattcagcatctccttcgttttctattagtataaaggcacatgcagcaatatgaaaagcgcctatcagagctgataggcgcttagggatcaagattacttgcccgaatctttcattgagccgtcatctttaccatctgtcttgtcttttgtgccgtcttctttgtcacctggtttttcttcggtttcttttttaggcgtcacatcttttttctcggaagactgctgaattgacccttccgtttcttctgttacagcgtttttctcttcagccgccgctttttcaattgatgttaccggcttgtccataaaattgagcgggttcatcgctacgccgtccttgcggatttcaaagtgcacgtgatttccgctttcttcactgtaaaggttttttccggatttgccgatgacctggttctgctttactttgtcgccctgatcgacgctgacttcagataaagactgatagacagtagacaggccgtctgagtgttcaatttcaaccacataccccagtaccgggtctttagcagctttaacaaccgtaccgctcagagaagcagaaacatcaaatgattttccgtctttctcagctaagtcaattcctttactgaggctgtacgtgttattatagttaacaagtgctgcttctttctctttttttgcggcatcagattcgtaaaactttttcacaacagaaacattttcagaatgagcagccggcattgcgacgttttccattgacttgcctacttcgacggcatcgtctttgccgctgtcatacgcggagtttccgccgttgttcgtcagattgtccttcacatcattcgaaacggattgataccaaaggacagctgttaaaatgacggccgcactgactaagtagattgcagggaatatccagcgtttgcgaaaaaaccgctgaagttttttgacttgagaagttttcttttcttcctctctcatttgttcatcacctcagcaacattctgaacacttttctgaaaatatatacacatccataaaaaacttttttggaagtagtatgtgcagattgcacttaattatgtaatgaaatgtgaagggagatcccggaatatgaatttgaccctgcgcaaagccgtattggaggatttagatgcggtggtggccatatacaactcgacgattgcctcacgcatggtaacggctgatacggaagaagtgacgcccgcagaccggatggattggtttttgcggcacacggaccggcgcccgctgatggtcgcggaagatgaaaccggcaaagtggcggcctggatcagctttgaaacgttttacggccgtccggcctatgacaaaacggcggagatcagcatctatctgcatcaggattgccgcggcaaaggagcaggaagctttctgctgaaagaagccctggcactcgctccgacaatcggcatccgcagcctgatggcttttatcttcggacataacgtgccgagcattaagctgtttgaaaaattcggttttaccgaatggggcgtattcccgggtatcgccgaaatggacggaaaacgatatgacttgaacattttagggagagaactgtcatgatcaccatcgataaagacaaagacgaaaaccagccgctcaataaaaaagcccgttcccttgccgacatcgccaaatggggaaagatcaccgccgtgtttctgatcatcacgggctctctttccgctctgtcagccattgtgacgctgctcggagccattccgggtgttctgctcatcatttccggcgtcatgctgatgcgctcggcaaaagcggctgccgcccttcaggaagggctagaagaaaacgcggaagaaaatatgcttgcacattacgcgtcatttatcaaaatgcagtttttttacgcggcatccagtgtggtattgggcattctcgcttttattttagtcgtcatcttcgctgtcatcggaattatggcttattacagcactgatacgtatgacacgcctgattcatattactatgagaacgaccctgtgtttgaatgacaaaaagagctgatcgcgcgtcagctcttttttaataaagcatttcttttttccggtcttcttccgttaaaaattcaataaagctcttcatcgcagacggctcctcggcaatcagccgggtataggcgcttttccgttcctcagacagaatatcgctttttctgatcctgttcagcatataaaggcggatcgttttttgcacctgtttccgctgatagccggcttccttaaaaaacgcaagacccagagccgcaaggagggcaaaaatgccggccgatacgagagctcctctcccggaaggggcctgaatcaaaagcgatgccagatgaaacagactaaaagcggcgagcgggaaagcaagaaaacggtaaatgatgctttttttcatcagcggcgcgatggcgatttgtattttctgaatttctttttttatgaatcccggcaattgttccgcatgctccagcttcatgccctctcccctttgctgtcatttttgtcttctttttcatatatgcatattttaccgcacccggaactttctttgaaagaaaactgcattcatctttgattccggctctttattctttcaaaatgtcaatgttataatttgaaatgggaatcagattgctgcacttgtcggaatactaatgggcacagtcttgataaatatgatatagcggggttgcaaagtgagcatttcatttattttattcggattttttttcgttttaaatatacttttggccgtcatcatgattttcaaagaaagacgcgatgccagcgcttcatgggcttggctcttggttcttttttttattcccattttagggtttattttatacctgttattcggccataacctgagacgcaagcatctgtttcaatgggaagaccgtaaaaaaatcggaatagaaaagctgctgaagtttcagctgaaagatctgaagtcgaggcaattccaatttaacaacagggcgactgtggataataaagacctcatctatatgcttgtcatgaacaaccacgcagtctttacagaggataattcggtggagattttaacggacgggcgcgataagttcaaacgcttaatgaaggacatttccaacgcaaaagatcacattcaccttcaatactatatttataaaggtgatgaactgggaaaaaaattgcgcgatgccttagtgaaaaaagcacgggaaggcgtaaaagtcagagtgttatatgatgaactcggttcaagatcactcagaaaaaaattcttcaaaccgctgcgggacgccggcggccatgtggaagtcttttttccttccaggcttcgtccgattaatttgcggctcaattatcggaatcaccgcaagctcgtcatcattgacggcgaaaccggctatgtcggcggctttaacgtcggagatgaatatctcggcctgaatccgaaattcggctactggcgcgatacgcacctcagacttcaaggcacggcggtacacgccattcagacacggtttatcctcgattggaaccaagcgtcccatcaccatacgctcacttacgttccgaatcattttccggaatgcgagccgaagggcaatgtcgggatgcagattgtcacgagcggacctgattcagaatgggaacaaattaaaaacggctatatcaagatgatctcaacggccaaacgatcgatcctgattcagacgccttactttattccagactcaagtcttttggacgccctcaggatcgcctgtctgtcaggcatcgacgtcaaaatcatgatcccgaacaaaccggatcacgctttcgtttactgggcgactttatcttacatcggcgatcttttgaaagccggagcctcagtctacatttacgataacggctttattcatgcaaaaacgattgtcgttgatgatgagacggcttcagtcggtacggcgaatatcgacgtcagaagcttcagacttaattttgaggtcaacgcctttatttatgacgtcaccatcgcgaaaaaactcatttcctcatttaaagaagatctgctcgtctccagaaaatatacgtatgaagaatatcaggagcgttcgctgcggatccgcattaaagaatcgatttcaagacttctgtcgccgattttgtaattcccggggtgtttctcgggaattttctgatataaaaacggacacggcatgaaaaaacacattttatattcaaaagaatgaccgaatagtgtataaatgaaaagtgagtatttttttgtaaaggagtgccatagtttgaaacctgaatcagtgaatcgttcgcttatttctatttcgaaatggggaaaagcgacaggtattttatttattattataggcgcgtttgcggcgctgtcgggcgcgtttttctttttaatcggagccattcccggcgttttgcagatcattgccggcatttttctgatgcgctcggcaaatgaagcgggacagatggcggcgcagttcaatgaactgacagaggaacatatgctggagaattatgcaaagttcgtgaaaatgcaggggatctatctgatcgtgacggtcggcttgtccgttctcggtatcgttcttttcattgtcctcatgacgctcggcatcgtggacggcgcgtttaataatattgatgccaatacatattaaaaaggaaaatcccggcgcatccgcccgggattttttcttattccgcttcttcgacaacggtaaagtttttctgctttggatttgccaatacggcgaacagcattgacgctgtatgcagatattctttcggcaaaaaagttttttcaaataaaacttttccccagagtttcaactgaaatcactcagttctgcgaaataaggctatggcggtacaagaccactcatcatacagttttttgggtctttgtaattaaattacaattgttcttaatattcactcatgtattcatgctattatattgaaaggaacgatcaaaagcgttggcgttcgttaaatatttacgagtgctgcctcatgtcaaagtcagaaaaaatagtataggaggtaacatatgtttaagtttaaaaagaaattcttagtgggattgacggcagctttcatgagtatcagcatgttttcggcaaccgcctctgcagctggcacagattactggcaaaattggactgacgggggcgggacagtaaacgcagtcaatggctctggcggaaattacagtgttaattggtctaataccgggaatttcgttgttggtaaaggctggactacaggctcgccatttagaacaataaactataatgccggtgtttgggcgccgaatggcaatggatatttgactttatatggctggacgagagcacctctcatcgaatattatgtggtggattcatggggtacttacagacctaccggaacgtataaaggtactgtaaagagtgatggaggtacatatgacatatatacaacgacacgttataatgcaccttccattgatggcgataacactacttttacgcagtactggagtgtccgccagtcgaagagaccaaccggaagcaacgctgcaatcactttcagcaatcatgttaacgcatggaagagccatggaatgaatctgggcagtaattgggcttatcaagtcttagcgacagaaggatataaaagcagcggaagttctaatgtaacagtgtggtaacagctcatctttaatgaggggcagctaacgggctgctgatcgttccttgagaaattttataatgattgtgaagaggcgaacggttttggcattaccggaggcaggatattctccatcagtttttttagcgcgtattaaaataagagttccgtcttttttcggtaacccgcttacaacagacaccttcacataagccttaagcaaaataaaaatatcccggttaccacctcctttagtttcggaggatttcttcattaaacagatcgcaatcccgcatccaggcttgtctgaatatagagccaaaaccgtgatttcctcattatccattgtaaccatttccgttacacctctagcggcatgaacccatctctttttaacaaaagagatgattcattacatcataaagggacttgctcgcaagttcattctccattgcccgctgtacgcttccgaacgtctcatcgagcgcgcgctgaatatttttgccgaccggacagtcggggttcggattgtcgtgaaccgcaaaaagctcttccttattctgcaccgccctgtaaacctctaagagggtgatctccgacggatcttttttcaggctggctcccggaatacccgcccgggatgtcagaatacccgcttttttcagctggctgatcgttctccgcactacgacgggattggtgtttacgctgcccgcaatcatgtccgatgacgcccgttcatccgttgagatcagcgataaaatgtgaatggccacagcaagacggctgttaatcatgtttttcaccaccgttgtaaccacaatggttacatttcatttgtttgtcaactactaatatacactaaaacgggcggcaggatgaaatcaagttggcaatagagggtaaacaggccggcgggaaaccggccggagagggattaaaataagaaataacgctgtcctaacggaacataactgacgggctggcatgccagctcttctccgtcggcgaacacctgataggttttcggatcgacatgtatattcggcatcgcgtcattcagcttcatgtcgagcttactcagcttacggatattccgtacgggagaaatcattttttcaaggccgagcttttccggcacaccgtttgcgataccggcctgggacataaatgtaatagaggtatttcggtttgctttaccgtaggatgcgtacatctgccgcataaacacgggctcaggcgtcggaatggaagcattcggatctcccatctgggcgcgggcgatcatgccgcctttgagcacaagttcaggtttgacaccgaagaaaaccgggtcccatagtacaaggtctgcaagctttcctttttcaacggaaccgacttcatggctcaggccgtgagtgacagccgggttgatcgtgtatttggcgatatagcgtttggcgcgcacattgtcattgccgttttctcctgatagagcgcctcgctgttttttcattttatcggcaacctgccatgtcctgataatcacttctcccaccctgcccatcgcctgcgagtcagatgacgtcatgctgatcgcgccgatatcgtgcagaatatcctccgccgcaatggtggccgctctgatgcgtgaatgactgaacgccacgtcttcaggcacttttgaatctaaatgatggcagaccatcatcatatcaagatgctcgtccatcgtgttgacggtatatggaatcgtcggcgtcgtagaggacggcaggatattggcgtaagatgcgagtttcataatatccggtgcatggcctccgccggctccctctatgtgatatgtatggataacccggtcgccgatcgcatcaagcgtattttctaaaaagcccgcttcatttatcgtgtctgtgtggatcgccacctgaatgtccgcctcatccgctgcttccatgcaagctttaatggcgcttggcgttgatccccaatcttcatgcagcttcaggccgatcgcgcctgcttccacctgctcgatcagcggcgctttatcggatgcatttccttttcctaagaaaccgacattgatcggaaactcctcggccgcttccagcattctcgacatgtaccatgcaccggatgtacaagtcgtcgctttacttcccgtcgcaggacctgttccgccgccgagaagcgtggtcacacctgaagaaagcgcgacttccatctgctgcgggcagataaagtggatatgcgtatccaccccgccggccgttacgattttcccttcgccggaaatgacttctgttccggcaccgataatcatgtgcgggtccaccccatccatcatatcagggttgccgcttttcccgacgccgacaatccggccgtccttcaccccgatatccgccttgacgattccggtataatccaggatgacggcgtttgtaatgaccagatcaagcgctccgtctttcccggtgatacgcccgttctgccccatgccgtcccggattgttttccctccgccgaaaatcatttcttccccgtaattcgtgaaatctttttcgacttcaatccataaatccgtatctccgagtctgactttgtctcccgttgtcggtccgaacagttctgcgtattgctcacgtgacattttcatcggatcgcctcctccatccatccggcttttttaagatttgacagcgtcttctcttttccccgctcatccatatacgtatcggccatgccgttgaggcctctgaccgtttttcgccctccgatttccacgagcgtgacggttttctcttctcccggttcaaaacggacagatgtgcctgacgggatatcaaggcgcatgccgattgctttgtcccgattgaaggaaagggcgccgttggcttcggcaaaatgaaaatgcgatcctacctgaactgaccgtgttccgttattggtgactgacacctccagcgtcttccggccttcgttaatggtgatggtcccctttgcgacttgaatcgctcccggcttcatgacttcacctccgctttgatcggctgatgaacggtgacaagcttaaccccgtccgggaacgtcgcttccacctgaatgctatccagcatttccgcaacaccttccataacgtctttttccgtcaatacattgcggccggattccatcagctccgcaacgctttttccgtctctcgcgccttccatcagataacaggtcaaatatgcggcggcttcgggataattcagcaggacgccgcgcgccttccgttgcttagcgagctctcccgccgtaaaaataagcaatttttcttgttcaaccggtgtcagtttcatctgtattcccccttagtgatagtcaaacgcaatccgcatggtcataccgaaacgatgcaggcggccgttacccccttcacctcatgaaatgttaagtgataaaagttattcgacggtgaacggcccgattccttttgcagaaatgaccgatttctcatttttttcttcaacaaacgtttaattaaatgtgaagaaaggttacattctttgtgaatattataaagaaatcgccggggaatttatagaatatttaaaaatttagtgaatattaaccaaacgaactggaatttttgtcatttctcataacaaaaagcccaaaatattttgggcttttgctgtgtttcacgatcaaattaatcatcactgagtttatctttcgttttaccgacacccttttgcaggctgcctttcgctttgtcttttttaccttccgcttttaagtcggacttgtttgccatgtcgcctgctttgtcctttgcttcccctttcattttgttcatgccgccttttactttgtcttttaaaccgttatcttcactcatgatctcttcagctccttttgtttttgtgtacttgttttcttccctttcagcctgatagcaaacatttcaactctcaattattgatttcacagcgttccccgtagcggatcactttgtaaacggccaatccgtctgacagcttattatccccgtattgcacgggcagaagagcaaagaaaacataataagttgaaaaatagacaaattggtaaaaaaataagtttggctcaaggacatcttttatgatcagcagatttattaaaaagatagaagcgagattaaacagacagcctccggaatagacgagcgcgctcgtcaggcggttatctatccgcaattcgccgaacttgcagaaagaatctatgaagtagatacgccgaacctgaatcggccctacttttaaaagacgtttccccattccgatatccaatgacgccttgcctccgaacagcatggccataaagctgtgtcccgacacatggatgacagacaccatcgggagaatgatgagaaatgaaacgaaaaactttatcatatcattaaatccgaacaacaaatccctccttcccatcgtacttttttccctcttttgcgatttttccgattttttctatgatcaaacgtcttgatgtgcataaaaaaataaccatctgctgatcagatggttaagaaaattatatatcgtataaacactgttctttttgaatgttttctctcatgcgaatcgctttttcataaaaatacgccgcttctttatattgctcatgtgcgcttgtgtaaacggcggcctccaaggcgaaatcttcaatatacacatacagcgatttttcattcatatagtcaaacacttcatggattaaatccatattgagagactccaaataaagcgcttgtaaaaacttatacttctctaaactgaatcggtcgccgcgttctttcgcgatcatgatccctctttcataataggtaagggccgcttggtcatcatgcagcctgaaaagggtgtgcgttaagctgaacagcgccttcggaagctgttcaagctgatgctcttcaaaaacgggaaccgcttttctaaagtaccgggccgcttcatccagatcccgcttttcagaataacaattccccagattgtaaagcgaagacccgatcaggcggggctgtccttcaagcaaagaaaggcggagggcttcgtctaaatgctcaagcgctttgtcgtagtttttgcagtcgatgtagtttcctgagatgacgaaatggcattgaattctccgcactctgtaaaaatcgtgtttcatatacgtatccagcgcctgaatcccgtgattcatggaaaaatgagtctgcttcatgacgtaaaacacttcagacatcttgaaatggaattccgccctctctatatcatcctcgacaaatgaaaggagtttttccgctttccggtaaaaagaaatagccgcaacatagttattgtgatcgaattcatacattcctctgaacaaatggaaataatactcagacagtcctgatatactgtccgtgctttcgatcgtcttttgcagctcgctgtactgaatctgtgattgttcggtgcattccggcttgacgtaatcaagcataatatgatggcggtagctgatcagctgataatataacagcagcagctggtcttcctccatacgttgtatatcctcatcaatttcctctttcagctttatggcatcagccgcttgaaacgctaaaatgtgcttgtaccatttgttgatcttgactccaacttgagatgacggaatctcgtatgcggtcatgcccctttcacaaccttttctaatttctattggttatattttaacatattgtatggctttggaattgcataacttgattgtcctgcatcaaaattcctatcatatatttcggctgtcaccggtattttttgaacagaccgctctcataatgtgaataaaaaagcctgcccttgtccgggcaagcttttcttcatccgcctatataagacatttccactttctttttcccatccgttttagaaagcgcgcggtcaattgaatactgatccgtgcgatttctccagacagaagcgatggattccgtcaattcatcatcggtcagaccgccgcgcacgagtttccgaacatcatagccgcttgacgcaaacaggcacgtaaacagctcgcctctcgccgacaggcgcgctctgttgcaggaggcgcagaacgcatccgagactgaggaaatcacgccgatttcgccggaaccgtcaagatagcggaacctggaagcgacctcccctttataattcgcttctatcggctccgtcggcatgtgctggttgatcagatcaataatttcggccttcgtgatcacgtcttttttattccattgattcgtattgcctacatccataaattcaataaaccggagaatatgacccttttctttaaaatagcgggccatcggcaggatatctttttcattgacgcccttttgaacaaccatattgattttcacaccgagtccggccgcttttgccgcctcaatgccctcaagcaccttgttcaccgaaacgccgcggccgttaatggccttaaaccgctcatcctctaaagaatcgaggctgactgtcactcgatgcagccccgcctgcttcagtttttccgcatacacgggaagcagagagccgtttgtcgtcatcgcgatatctttaagtccggggatgcgcgcaagttttttgatcaattcaggcatatcttttctcatgagcggctctccgcccgtcagcctgattttttcaacgccgaagcggccgacaaacagcttcgcaagccgctcaagctcctcgaaggagagcaattccgtcttttgtaaaaatggataatccggtccgaataattcggctggcatacagtacgtgcatctgaagttgcagcggtcggttacagagatacgaagatccctgagcggcctttcccttttgtctgtcacccggcgcgtttctgtattcataagcccaagacccctttctattgttcaacccgttcaggatgtgtgtatacgttaaatgatccgtttctgacaaaaccgatcgcggtgatgttcagctcttccgccatttgcagcgcgagctccgtcggcgccgattttgaaatgacaatcgacacgccgatttttgcggcttttaataaaacctctgaggaaatccggccgctgaagacgatcagcttgtcacggacgggcattccgtttttcaaacagcagccgtacagcttatccagcgcgttgtggcgcccgatatctgtcctcatcaagagcagcttttccgtatcgcacagcgctgcattatggacgccgcccgtttcccggaaggtgccgcttccgctttgcatctccttcatcaggcgaaggcacgtctcaggagttatggtaatccggctgacggcggttttggccgttttcacatcctgctgaaagtaaaaatggcggcctttcccgcagcatgaaccgatgaccctcttcgtatagtctttttgctcaagcactccgggattcgtcagttcaacatatgcaaacccgagactttcatctatagtaaagcttttgatctctttttcaaaacgaatgacgccttctgatgcgagaaatccgatgacgagttcctctaaatggtcaggcgtgcagacgagcgtaacaaattcctgcccgttcaccatgacggtcagcggatactctgaaaccatccgatctgccgtctttgttaatacccctttttcatagcggtatatgtctcttaccgctgttgttttttcatccactgttttcccctccgcagtatccttctcttttattcttccacaatccctgtattttgtcgaatttgcggtttaaaaaaagagccctcttcggactctatgtttcgttgcgatgatgtctgctcaaaatggtgaataaaattactgcggcgataatggccaatatactgacgaatatgaaggcggcaagcttcagaaaaatccctatcagaacaaaaacgactgccgccagcaccaatataatgcctgctccttttaacaacagcgttcatctccttttatccgtatcattcccgcggttccgttttctaaacaaaaaaagacgccgcgcgggcgtccttttttaacctattcttttgctaaatcctttgcagcgtcttcccaagcctgtttgaactcgtccgcgctgtcagctgagacatatgtgccgcctcccgcttccgccgctttttcaaggctttcgcttcctttcatgccgaagttgaagccgatgatattgacgaccgtgttgacattcgctttacggagcttttgaatttcggcctgaggattcccgccgcatgtttcttcaccgtctgtgatcagatatacgacgtttttccctttagcgccggcccgctcaaattcttcacgtgtatcagaaagcgctttcgctatcggtgtccagccggtcggtttaatcttgctgagtgattgctcaaatggagtcacggcgtacggctgaaggccgtataacgtttctgtcgcgttacatgatacggctttgcctgagtttttattattgcccttatgcccgaatacccgaagcatcagattcgtgtcttcaggaagaacttccgcaaaagaagtgacagactctttcgcaacatctattttacgctctccccctgttttttgtatcatgcttccgcttgcgtcaaacagcacggcgacatttgtttcttcgtgctttttctcagctgcaaaaacaggcgatccgagtgaaagcgtcaaaagtccgacaatccccgcagtgaacatttttttcatttccttcattcctctccgtttgtttttggccgatgggcccccggctcttctctatgctagatgaggagtatgcaaaaagatatagggcgggattccttttgtataagcggctgtacgccgttaaaaatgaacagaattatgcgcatcatcctaaaaagattggataaatgatgacagatttaatgcctttttcgccctttttgtaatataagtccggaatctgattctttttacagttttctcttcatcttttcttgaaacttttgttaaatggaacataaaaaaaagggccgctaaacggcaccttttcttatttcgctaatgaactcgcttccatcgtaaagatgcggttcatatccttttggctgtgagcttcgtaatattttcctccgcccgcaccggcaattgcgtgaagctgtccgttgaagccttctttaaagtcaaagccgatcacgttgactttaatatgatgtttgcgaagttctttcgctgtcttaataggatctccgccgcatgtctcctcaccgtctgtcaacaggtaaacggatttaaagccgaatttatgaacgccgttaaaagaagccttcgcatcttctaatgcttttgcaatcggtgtccagcccgtaggcccgattccgttcagagaattgaggaagctctgtctgtcaaacttttggaatccgtatacaccgcgaatggattcacaagattgaacttttccggagtttttattattgccttccgaaccgaaaaccgtcattctgacctgtgatgtagacttaattcgatctgcaaaacggacgatttcatcttttgccatattgtatttagaaacgccgtcaatccgtttcgccatactgccgctcgcatcaagcaaaatggcgatattgtttttaaataaaaatgtcttctcgtttgcattctcggcagcaaaagcaggagatgcagcagtcagcatcaatccgagcatgattatgagtgaaagtgtttttttcattgcttcttccccttttcaatagatttacgttcaacgccgaacaatatttatcgtaaatgagatgaaaagggaaataaataggacggcgttcctcattatttttgcgtatattcacatagatgcggcatttttatcagtgattttcacccgtcgctcagccttcagacggcatttgtcagcctttaggctttcgttatatgagtctgttggttgctttaccgtttatggaatagttttcaaaaaaaacagacgctcatgaaagcgtctattttttcgccatatatttgtttaaaaatgaatctgcttcggatatgtccactccctgataataatgcttgacgatgtccgccacggatttcccctgctccgccatgtaattggccccgtactggctcatgccgacgccgtggccgaatccttttgtcgtaatggtgatgctgccgccgttccgtttccattcaaagtcggcagaacggagtccgagtttttcccggatgtctcttcccttcagctttttgccgtttatgacggccgtcgccacttgatggcccggcgttctggctgtaatctgccctaccgtgttttgtcccgagagctgcacgccgagcttttgctgaaactccggcacactgaaggtctgggtggcgagatatttcggcgattgcttatcccacggacttttcacgctctttaaataaggaatggcgcttgtccaataggcttccgcattttccgtatacccgttgctcgtagagaagaaagatgcctcaatcggcttgttgtcgtacgttaaaatctttccttgcgtgcctgcgaccgcgtttgtgattttcttgaggttgtgtgcgtacttagaaccccattcttttttcagctggcttttgctttgatagacttggaacatttgcgtatcatccaccagtgatcctttcggcgcctgaacggctgagtcagcgaccatcagtctgacgatgaaagtccgggcggcgagcgcctgggcttttaaggcttccggtttaaagtttgcgggcatttcggaagccacgacaccgatcacgtactcttcaagcggaatgttctctacagaatgtttggatgtccgataaaccggaatggatacaggtgattctttcaatgtttctgctccttttgtttctcgtgtggtgtgtgctgttttgtgtccgggctctctgtttacggctgctcctttttccgcctgaaacggaagaacgagaatggtgggaacaagaagaataagtatacacagcccggatagtagaaatacaatcggtttcatatatcagctgcctcctgcttgggattcgactctacttcatcttatgggcagggacaagctaatatgacttccttttggacagaatctttattccgtttttcacgcgaaaaacgtattcttttttgaaaatcagagcataataatgatgataaaccataaaaaaacagtatgccagattgacatactgtttttacagccattatgcgtttaggtcagttacgacttctttgctttcttgttcagcggccgtttcatcaacgacacgctcgatgtcagcgccgagagccgcaagttttttatggaaattcacataaccgcgatccaagtgcttcagttccgtgacgcgtgtatgaccttcagccactaatcccgcaagaatcagcgccgcgcccgcacgcaggtccgtagcggcaacttctgcgccttgcagctgtacaggaccgttaatgatcacagaacgtccttcaattttaatgtcgccattcatccggcggaattcttcagcatgcataaaacggttttcaaacacagtttcagtaatcatgcttgttccgctcgcacggagaagcagcgccatcatttgcgactgcatatcagtcgggaatcctgggtgaggcatcgttttaatgtcgatcggcttcagctgggcaggaccgatgacacgaaggccttctccttcatccgtaattttgactcccatttcttccattttcgcaattaaagacgtaagatgctcaggaaccgcaccttttactaatacatttccttccgtgatagccgcagccaccatgaaagtacccgcctcaatacggtcaggaatgatgttgtgtcttacgccgtgaagcttctcgacaccttcaattttaatggtgcctgtgccggctccgcggatttttccgcccatcgcattgatatagttcgctaagtcaacgatttcaggctcttttgccacgttttcaagcgttgttgttccttcagctaaagcagctgccataatcaagttttctgtcgcacccacacttgggaaatctaaatagatttttgcgccctgcagacggccttccacttctgcttcaataaagccgttgcctactttgatttttgcacccattgcttcaaagccttttaaatgctgatcaatcggtcttgagccgattgcgcagccgcccggaagcgctactcttgaatgacccgtacgggctaacagagggcccataacaagcactgacgcgcgcattttgcgcacatattcaaaaggtgcttctgtttctaaagcgtaagaagcgtttacggtaacttcattattctcaaaatgcacatctgctcctaaatgacgcaacacttcattaattgtatatacatcggagagcgtaggtacatcacatattacgcttttttcttcacttgctaataaagatgcagcgataactggtaaaacggcattttttgctccttcaactttcactgtgccgtttaacttctgaccgccgcggacgatgattttttccaaggtattcccctccgcgtccctatattctctatattaatattcagtcgtcacgattggtgtgccaaccgtaacggtatgttttccgcccattcccgcacttctaagcgcaacttgcacattcatcttatgtttcgatgtcatgatgtaatctgtccacttatatgtaaatgcagaaacagaaacgaaatgaggctcaactacatgttcaactggacttgcttcaaattctttcatgagctgttctgcttttttttgcaaaacaatactcatattatcatttaaatgaccctttagacaagtaaaaataaatactttattttgaaatatgtcatgtgcctgccgttcaaactgttcatatgtatcattccagttttccggttgctccgggctcatttgctcatataataaatacgaagttgggttctggtttttgagggtagtgacgagctgcagtttaaaagttgtgtgattttttttgtcagaatacgtgccgacggcctttacgattttatcttcccgcgcggattcccaatgatattgcggatactgcgtcttcagttcttttaccttgtcatcaaattcactcagtgacaggttcagattttttttcgcatgaagcgtccattcatccacagtgacctgctgccgctccattccttcggcaatctgggcaagcggagacagctcacttgcatgaatggaatgaaataccgctattaaggcgcttaaaaaaacaaaaaacaagatgatgcggcctgctctttttttcttcatatcgatctctcccccttactcccatttttgccggagccggggaaagcaatacatggaaaacttcgtcaaaactcgccaagcgggtgaagaaaaattggtttctcacccagcgattcccttcatttcaacagacgaaacatcttaaaataagtatggaagctgtttcgaataggtaagataatctaaaaagaagttggcgactgccgtaccgatcgcaatggtaagaagaatgatcagcagcctcgcctgcactatttttccttttcggatcagcggatcaaagttgacggcctgaagcgcccaccatgtcaccgcaatgcataccaggtgaaccaggatgctgattgcggcctgctgccccaatacattcacaaattccatctcctttcattttttccgcccctcatatcctctcttattatataagaagaagagagaaagatgatcatttttacatcagaatttttatccaaaattaggggcaatccccgcttaaatgtccgttctccggcatgatatacttttttggaaaggagatgggaatatgaatcattccttttttcatccggaaaagcagtatggagaaacacttcccgtatttgaccacgagtgggaagcgatagcattctactatgattatagacagtctcaaacagaggaactgaaagaattatgtcagtttttcaacatttctcttgattattcacccggcagcctgctggcagtggaagctctttacttccgcagcataaaagagctgcttttggcggattggaacctgccgattgacgaatttgagaaaatgctcagtgtgtatgtcatcgattgcgccatcagacatcatgacgatgccgaatgggtcgtcaaaccttatccgtatacggacggcgcttatacgacgggtgtgcggagaggaaacaaaacgtggcacaccgacaactgctgcgaacatttatatctgcaaaaagaagaggatcatccgcttatcggcgtctatgaatctcttatgcgttaatatagaaaaagaatccttctcagacagccgagaaggattcttttttagtttcctgcaacatccaatctgtttacagcccgctgtaacgcaagctcagcccgacgaatgtcagtatcatctgatcgtttgttcaaacggtcttccgcccgctttttcgcagcaagggcgcgctctttatcaatgctttccgctgtttcagcggcttgtgcaaggatagtgacctgatcaggacggacttctaaaaatccgccgctgacagccgccaattcggtctgcccgtcttttttaaggcggacagcgccgattttaagcggagccacggtcggaatatggccaggcaggataccgagatcaccgctctcggctcttacactcaccatttcaatatcagcatcatatactgggccgtcgggagtaacgatattgactttaacggtcttcatgcttttaccctcctaggaccagattaaacttctacacccatctcttttgcattctcaatgacttcttcaatgcgtcccacaagacggaatgcatcttccggaagatggtcatatttaccggaaaggatttctttaaagcctcgtaccgtttctttaacaggcacgtaagaacccttttgtcccgtaaactgctcagctacgtggaagttttgagaaaggaagaactggatacggcgtgcgcggtgaacgacaagcttgtcttcttcacctaattcgtccataccgagaatcgcgataatatcctgaagttctttgtaacgctgaagcgttgactggacttcacgcgccaccgcataatgctcttctccgacaatttccggagcaagcgcgcgggaagtggaagccagcggatcaaccgcagggtagatacccatttcagttaatttacgctcaaggttagtcgttgcatccaagtgagcgaacgttgtcgccggcgccgggtcagtgtagtcatcggcaggcacgtagatcgcctggatagatgtaactgaaccaacgtttgtagacgtaatacgctcttgaagctgacccatttctgtcgcaagcgtcggctgataaccaaccgcagaaggcatacggccgagaagcgcggaaacctctgaacccgcttgtgtgaaacggaaaatgttatcgataaagaacagtacgtcctgtccttgtttatcacggaaatgctcagccattgtaagacccgtcagtgctacacgcatacgtgcgcccggcggctcgttcatttgtccgaagaccatggctgttttcttgataacgcctgaatcgctcatttcgtagaaaaggtcgttcccttcacgagtacgctctcctacaccggcgaatacggaaataccgccgtgctcttgcgcgatgttgttgattaattcctggattaatacggttttacctacgccggcgccgccgaacaatccgattttaccgcccttgatgtaaggagcgagcaggtcaacaaccttaattcccgtttcaagaatttcaacctcagttgaaagctcatcgaatgaaggagctgatctgtggatcgggtccttttgagcatccgcaggcagcggttcatttaaatcaattttatctcccagtacgttaaatacgcgtccgagagtcacatcaccgacaggaacggaaatcggcgcacctgtatcaacagcttccattccgcgctgaattccgtccgtagatgccatggcaattgtacggactgtatcatcacctaaatgaagagcaacctctagcgttaggtcgatgcctacttcattttcgcctgtagctggctgtgaaactttaatcgcattataaatcgcaggcaagtggccgtcctcgaaacgtacgtcgacaaccggtccaagcacctgacttacgcgtcctttcttcatcgctatccctcctgacaaaatctttctattctaaagcggctgcaccgccgacaatttcggtaatttcttgtgtaatcgccgcttgacgcgcgcggttatatgaaagcgaaagtgaatcaatgagttctttcgcattatcagtcgcatttttcattgctgtcattctcgcagcgtgttcacttgctttactgtcaagaagcgcgccgtaaattaagctttccgcatattgaggaagcagcacttcgagcacctcttcttcatccggttcgaactcgtaagaagccgtgcgcttcccgccgctcgttccgaaatccgttaaaggcagcacttttttctccgtcacttcctgtgaaatcgcactgacgaaatggttatacaccaaatgcagttcatcaaaagcgccgtcgataaacatttgaaccgtctgacgggtcaaatctttaatctgagcaaaagtgacctcgtcgccaagccccactaactcagacaaaatcggcatctcccgttttttgaagaaatcgcggccgactctgccgattgcaatcaccgtgtattcatctttagactgatggcgttcttgaatggtgcggtaagcgtttcgcaaaaccgaactgttaaacgcacccgcaagcccgcggtcagacgtaatgacgagatacgccgtctttttcacttctcttgagacaagcatcgggtgtttcgcgtttttcgcgccttttccgacgttaaacacaacctcctggatcttatccatatacggagcaaatgacttcgcgttggtttccgcacggttcagcttcgcagcggataccatctgcatggcttttgtaatctggcttgtttttttcgttgacgtgatccttgacttaatatcgcgtaatgaggccaaagatttcaccacctttattcttcatttgcgtaaaaagagagaaaaagagaacctttttctctcatcttctaagggttagttgcttggtgcaaatgtgcgtttgaagccttcgattgcagctttgaagtcttcatcagcaggaaggtttcctgttttcgcaatgccgtcaagcagatctttatggttttgatcaaggtacatgtagtactcttcttcaaaacgtctgatatccgcaaccggaatatcatcaagatatccttttgtcagcgcataaagaatggctacctgtttttcaaccggaagcggcttattcaagtcttgtttcagcacttcaactgtacgcgcaccgcgattcagtttcgcctgagtcgcctggtcaagatcagatccgaattgggcgaatgcttcaagttcacggtatgaagcaaggtcaagacgcaatgttcccgctacctttttcatcgctttgatttgggctgacccgccgacacgggatacggataatccggcattgatcgcaggacgcacgcctgagaagaataggtcggattgaaggaaaatctgtccgtcagtaatggaaatgacgtttgtcgggatataagcggagatatctcctgcttgtgtttcgacgaacggcagcgccgtaattgatcctgcgcctttagcgtcactcagcttggctgcgcgctcaagcagacgggagtgaagatagaatacatccccagggaatgcttcacggcccggcggacggcgaagaagcaatgacagctcacgataagcggctgcttgtttggacaaatcatcatatacgacgagaacgtgcttgccgttgtacatgaattcttcacccattgtcacccctgcatacggtgcaaggtaaagaagcggagccggctgtgaagcggacgccgtcacgacaatcgtgtaatcaagcgcgccatgcttacgaagtgtttccaccacgccgcgcactgtagattctttttggccgatcgctacgtacacacagatcatgtcttgatctttttggtttaagattgtatcaatcgcaacagatgttttacctgtctgacggtccccgataatcagctcacgctgtccgcggccgatcggaattaacgcgtcgatcgctttgatacccgtttgcagcggctcatgtaccgatttacggtccattacgcctggagcctggctttcgatcggacgtgttttgcttgtcagaatcggacccagtccgtctaccggctgtccgagcgggttgacgatacgtccgattaattcttcacctacaggaacttccatgatgcggcccgttcttttgacctcatcaccttcacggatatctctgtaaggtcctaagataacgatacctacgttggattcttcaaggttttgagccatacccaaaacgccgtttgaaaactcaacaagttcaccggccatacaattgtcaaggccgtgcacacgcgcaataccgtctccgacttggatgactgtacctacgtcatgaacttcaatttcagattggtaattttgaatttgctgctttatcagcgtgctaatctcttcagctttgatgctcacttaggtttcaccccttctatcgatttcctccggcaagttgacgttccatgcgctcaagctttccgcttacgcttccgtcataaatccggtttccaatgcggactttaatgccgcctattaaatccgtctgcacttcatttctgattctgagcgaagcgattccggctttttttgcaaacacttgagacaatgataacatttccgcttctgacagcggttttactgaataaacaaccgcgtcctctgtctgacgggcctgattggcaagtttgataaactcgtctgtgagatcaggcacaatcgaagaccggcggcggtcaatcagaagaaaaatcgtatgcagcacagactcagacagtgcgccgaacgattgctgaatcagctcttttttcttagcggccgataccttcggatggcttaacacttcctgtaatccggcttcgttccggaacacttcttttagtacggtaagctcttcttcgatttcattgatttgagaagtctcaacggcaatgtcgaaaagcgctgacgcgtatcgtttagagacagcagatccactcatcggctttctcctacctctttaagatagtcctgaatcagttgttcctgggcttgttcatcaagctctttttcaatcactttcgatgcgattaagacagaaagtgatgcgacttgctcgcgaagtgcggaaaccgcttgttctttttctttgacaatttcggttctcgccgcttctttcaatctttcagactcggcgcgtgcagcctggataatgtcttccttctgcttttcacccagttttttcgcattttcaatgagtgattgtgattcctgtttcgcttcttttaaaagaacgcgctgctcttcaatcagcttctgcgcttctttatttctttcttcagcggacgtaatttcgccggcgatatgatcttcacgctgtttcattatatttaatagcggtcccagagcgaatttcttgagaagcgctaataaaactaacatagctaacaattggaataggatatctccgccgttaaacgacagtcctaattcaagaggtaattgagacatctactacggcaactcccttctgcaggttttctctgctgataaaaagccgtttcgggacggcctgcttatcagacataaagcaatggcgaaggttctcttagagtgatcttcgccatttttagttcatataaggcttttttgcttagccaaagaacgctaagaacgcgataacgacagcgataatcggaagggcctcaaccaatgcgatacccatgaacataagagttctaagttcttttcctgcttccggctgacgggcgattccctctaccgtacgtgaaacgatcagaccgttaccaatacctgcaccaagtgcgcctaaaccgattgcaattgcagctgctattaaattcatgaaaaagttcctcctttaaaatgttatccgaatggatatatgattttaatgatcatgactgattttgtgtgacatgtacaccatcgtcagcatcgtaaagataaatgcctggatggtaccgatgaacaagctgaatgcctgccatgcaagcatcggaataatggctccgactgtgccgaccaaaccgagaaagaaactgtttgagtagaaattcgtcgccagattcgcaagcaggccaagaagaatttccccggcgaaaatgttaccgtaaagacgaagtccgagtgtcagcgtattcgcaaactcctcaatgatcttcatcgggaacataagcggaaccggtctgaggtaatccttagagtattccttcaaacctttcatcttcacgccgtaatagtgcgttaacgacacaaccataacggctagagtcagagtaatagccggatcggccgtcggtgatttccaccaaagctcgtgtccgaccgttacagaaaacggcagccctagcatatttgatacaaatatgtacatcagcaaggttacaccaagcgccaagaagttagcccctgtttttaaatccattgtactgcctataatattgcggacaaaatcaacaatccattccatgaagttctgggcttttcccggacggatggacagcgttcttgtagtaagaatcgcaatcagcagcacaatcacacttgccacagtaatcatcagaatgtttgtcagattaaaagtaagaccaaacaaatcaatagttctgtaatcgtgattcaatgggttttcacctctcttccattgatgaacgtttgagctgaataatggaatctatcataatgacgggataaattgtcattaatccaataatcacacttgccacactgactttatcgggatatttaaaggcgacagccatcgcaagtatcgcattgcaccaacgcgctgcgctcccgagtgatcgtatggactttcctttcgccacggccttgtcaaaagcattcattcttctggtcaagagccacaaattaaacaaactgaaaacagttcccaaaaagaggcctaaaaaaacagttttatacgccgtaagaccatatcccagcaaatagattgctaagattacaaatacatatctccgttgtctgctgaatgtaagattgggatcgtccatcaactatctgtctcctgatgaaaatgtaatataattcctggatacggcaaaacatgcggttaacccttgcagaaggccttttttgtccgcaaaacggcctgttcgaaaaaaccactcatcctcctgatgccacgggatgctgtttcattcgcttagataaatcctcatataacgggtttttttggaggatttaaaatgaggatggatactagaaatgaaaggaatgaaaaccttctcataataccctcgtttagcatacaatagcccctaacatgtgtcaatctgtttaaagttaaaaaactttttataccggaagcatacacagaatgttcacaaattcacctataaatgtatgaactctgcccattcagcaaatatctggataaaaaaagaaaaccccctgaatgaggttttccgatttatttggttccgtacagtctgtcacccgcgtcaccgaggcccggaacgatatagcctttttcattcagtttttcatcaagggcggcgatataaatatcaacgtcagaatgatgtttctgcagctcttccacgccttccggagccgctacaagacacataaaacgaatgtttctcgcgccgcgctttttcaggctgttgatcgcttccaccgcagagcctcccgtagcaagcatcggatccacgacaataaattcgcgttcttctacatcagaaggaagcttgacatagtattccaccggttttaaggtttccggatcacggtataatccgacatgtcccactttagcggccgggattaatttcagcatgccgtcaaccattccgagacccgctctcaggatcggcacgataccgagtttcttccctgaaatcactttggatgtcgctgtttgaacaggtgttttcacttccacttctttaagaggaagatcacgtgtaatttcaaacgccatcagtgatgcgacttcgtccacaaggtctctgaaatcctttgtgcctgtattttcattccgaatatatgtcagcttatgctggattaaaggatgatcaaatacgtaaacctttcccatactgtgttcagctccttttttgttgtccgagtgactttttcacacttctattgattctacagaaaaagacaaacagtttcaagaaaatcataaaaaaacccgccggattaaggttccggcgggtttcttccttattaatagtccagttctttatataaaggaaacttttcagtcaaggcagatacgcgctttctcgcttcttcaagttttgcttcgtcttcatgatttttcagcgcgaggccgatgatggcgccgacttcttcaagcgcgtcaccgtcaaagccgcggcttgtcacagctgccgtaccgagacggattccgcttgtgacgaacggtttttccggatcgtaagggatcgcgtttttattagatgtaatgccgatttcatcaagaacgtgttcagcgacttttccggtcagtccgagagaacggaggtcgacaagtacaaggtggttatccgttccgcctgatacgagctgaatgccctctttgttcagagactcagccaggcgcttcgcgttcgagatgacgttttgcgcatatgttttgaaatcatcttcaagcacttctccgaaagaaacggctttggccgcgatgacatgcataagcggtccgccttggattcccgggaaaatggatttatcaatctttttgccaaactcttcacggcaaaggatcattcctccgcggggtccgcgaagtgttttgtgagtcgttgtcgttacaaagtcagcgtaaggaaccggattcggatgaagaccggctgcgacaagacccgcgatatgcgccatgtctaccatgaagtaagcgccgacttcatcagcgatttcgcggaattttttaaagtcgatcgtgcgggggtatgcgctcgctccggctacgatgagtttcggcttatgcgccagcgctttttcacgcacatcttcataatctatatattgcgtgtctttatcgacaccgtattctacaaagttgtattgaacgccgctgaaattaaccgggcttccgtgtgttaagtggccgccgtgggagaggttcatcccgagcaccgggtcgccgtgctctaaaatcgtgaagtaaacagccatgttcgcctgagcgcctgagtgcggctgaacgtttacatgctcagctccgaaaatctctttcgcgcggtcgcgggcgatgtcctcaacgacatcaacatgctcacagccgccgtagtagcgtttgccggggtagccttcagcatatttgtttgttaaaacagagccttgtgcttccattaccgcttccgtcacgaagttttcagaagcaattaattcgatcttagtctgttgacgcttacgctcatctttgatggcgttaaacacttgtttatcttgtacaggtaaatgtttcatcagcgagatcctctcctatccgtttcctgttctttatttttaccacccttattgtacatggtttttcaggtgaatgtaacagcttatttaaaaaaatcacaaaatttaattagaaaacacgaacattatacaggaaaagcattttcatcattcgcattcataaacggcgcgaattccgcctatcagcttcggtcttgtccgggccatcgtcacatgtgcttctccaagctcacggctcgatatccggacagggacggcaacgggtttcagatgcatgccgatgaacgtatcaccgatgtcaatcccggcgtcagcctgaatcgattcagcgagcactggagaacgcatctgccggtatgcataagaggccatcgctccgcccgctttcgggacggggacggctgaaacaatggggagcctgaaccgctcggccgtttccgcttcaatgacaagcgccctgtttaaatgctcgcagcattgaaaagcaagatgcacacccgttttttccttaaaccggttaagtccgctgtatatcaattcagcccaatccccgcttccggcggtgccgatccggcttccggcggcttcacttgtactgcacccgatcaccagcagactgccgaccgtcagtcctgcctgctcttgaaactcagtcagcatgtccgtccatttttgcttcatctcttccattgtccagcacctcttacagatttttttcttcgtaatctgcgattttgccgatccgccgttcgtggcggccgcccgtaaattcagtcgtcagccagacttttgcgatttcgcgcgccagccccgggccgatgacgcgttcgcccatcgcaagaacattcgtgtcattgtgttcacgcgtcgcttttgcgctgaaggtgtcatgggcaagcgcacagcgtatgccctttaccttatttgcggagatgctcatgccgatgcctgtgccgcaaattaaaattcccctgtcagcttcgccgttcaccactttttccgctaccggaaaagcgtagtctgaataatcgacagagccggcgccgcattcacagcccatatcaatgtattcaatctgcaattcatccaaaagactttttatttcttcgcggatatggacgccgccgtgatctgacgcaatagctactttcattcatttacctcctaggtgtggctgggcgaagacagcccagtgtgcttgtcctttttattacgaaatccgttgatttcattctactctttcacattcgttttgcaaatgacctgtttgcagattttctgacagattacttgcttttcccgtcaagcaattgatcagccaaaagggtcagcagctcctccagttcgtcccgcgtctgtttataaacatcaagcggaccgccgaacgggtcagagatatcgccgttttcccccgttacgtattctttaatggtaaagactttgccctgactgttttgatatcggccttcaatcagctgtttatgctgttcggtcatcgccagcaccagatcggccgtctcgatatgttcttccgataagggagatgaactgtgattgagggcgatccgtttttcaaacagcgcttctacggcatgagccgacgcttttccgtgcggagacgcgaatacgccggccgagcttacgctgacatccagccctttcgtttctgctatggatttaaaaagagcctcagccatgggactgcggcacgtattgcctgtacaaacaaagattattttcatgtccgtcacctcttactgcctattataaatgaagaaaaaagaaacggcatcttcgtttctttttttacgtatcttatatcggtaaaagcagtttcagcccgaatccgatcaaaatggctccgccaagcgcttcgctgtaggagccgagccacgactgcacctttcttcccgccaaaaggcccgcccatgttaaaacggtgctgaagaccccgaacagcgtaacggccagaaacggattggagccgttcatcccgagactgagcccgacagaaaagctgtccagactgacaccgaccgcaaacagcaacagtcccgagcctgccggagatatgagcggcccgtccgattgtttaaacgcggcgatcatcatctgcacccctaaaatgaaaagaagagatccgccgatgtaaacggcgagcatccccagaaaaccggacagcagatgcccggccgccattcccacaagcggcatcatgacatgaaacagcccgatgacaacccctatatgaaaaatctgttttttcttcagctgaatcattcccattccgagtccgacggaaaaggcatccgtccccaaagcaaatgccatgatgcttaaggagacaagttccccgatgaatagattcgacatgaataaaaacccccttggacgtgcccgcttgtttagcttatgcatgtccgataaggggtagaacaagttaatggataacggtgccgcctgcggctttcatcagcctgttcataacggcgagccccactccggtatccggaaaggactcagaaataatcatatccacttccgcttcatcaaagctgcggagcgcatcgtataaggcggacgccactgtttcaaggtcggcgcgtctgccgcagaccttgatataatcagcctggtaactatcggcgttctcttctgttgtcaaaatgccgattcgttttccccggcttttatatgcgtctgccagttcttgaattctccgggcgccgccgtcggcaatagccatcggcgcagaaggcgcgtaatgtgtatatttcataccgggagaaataggaacctcatcttcttcggtcagccctttatccacaagaaccggaccggcggcggattcaatctgctcttttgtcacgcctcccggacgaagcagcacgggctgtttccccgtacaggacagaacggttgattccactccgattcccgtcgcgccgccgtccacaataccggcaatacggccgtttaaatcatgagcgacatgctcggccttcgtcgggctcggttttcctgataaattggcgctcggcgcggcgatcggcagtccggccgagctgatgagggctaatgctgccggatgatcaggcattctgaccgctaccgtctcaagtcccgcggtgacacggggtgacagcgcaccgggcttacacggcaggacaagggtcagcgcccccggccagaatagctccataagctttttcgccgtctcaggaatatggctgataaaacgatcaagctggctgatatgggatatatgcacaatcagcgggttatcgctcggccttcctttcgcctcatatattttcgttacggcttccgtattttcagcgttagcgcccagtccgtaaacggtttctgtcggaaaagccacaacctcattctgccggagcaattccgcggcttgtgtaatttggggatcggttgtggataattctgcggaacaatccacaaaccatcttcttgttttcatgtataaccaaactccttattttaaagcggtaaaactttattttctctcgtgtattccttttgaaagtataaaagatgtcctttaataaaacaagtgttatccacaaactgtggacaacactttttaataagtggataaccttgtgtataagttagatcaggcagaggttttcaccattaaaaacgaaccttctgtgcataacgagttgcggaaatgttcggacgtatacagttcatcaggcgcatcggcgcacgcttcaaatcccatcacattcagaaactcagcagatgagggctgattggcgactaagtagacatcttgaatctcatgttttttgcacagcacatccatactttgaaacagtgtaacgatatggctttgattcagcctgtccgacatgacgagtgaacggagaagcccttttccgccgctgaatttttcgatcccgagacaggcggcaatctttttttcgctgtcttccagcacgataaaccggctgatctgctgatcgatttccgcatgtgccgtatcagactttttcaaaaaggcctccagcgcctccgtatcttgatctcttgccactctcagctgataaaacatatatttccctccgtttcgatcaactctttcttccaatctatgaatcgaatccggatttatgccttttgcttcaggaaaatagatctgaaatccaatcgacgaggaaaaacttcacttcggtatcatcgtcatctttattttctttcttcgctttatcagcctttgcttttacgtcatccagcactttttctgtctgtttctgcgtttcttcctgcttctgtccgccgtcttcctgatctttcaccgcttcgccgtttgagaaatcaaggaagcacagcggcggaaacaagacgcaccaccagttggcgccctcgccattgccgagtgtaattaaaatggcttcatattttccggccggatagaccatattgccgtacagctttgtcggaaacgaaattttattgaattgaactgaaacggattgatgcgcacccttttctttcatcgtttgtttggcgatttctttaatttcaggaagcttcgaacgaatgagccgccgcgcttcttcaatggaagtgatatctttcacccagtccgtgatttgctcgtttacagcatctctgatctggcgcttgagcttttgatcctcatcgttatcactgttggccaaaatcctgagccggatcgcttcatccggtatgacgacgggctcatcggctgatgcccgcgccgtttcttcttttgtcaaacccgcaagcgctcctgataataaaagaaaaatatatatgcagatcatcattgtctgtttcatcggtccccaccgttcctctccgtgctttttttatctagtcccattatggacatgacggaaaaggtttaaaccggcgggaagaaaaaaatctagcaagctgataatctgcattgacagattcaaaatatggtacgatattattttgataggaggttttcagatgaaatataattacaccgtgctgctgtcggcggcatgtatgtctgtcatttattctattttgtatgttcatcaattcattatcgcggctttcatttcgatggcgttttattttttgtttccttatttgatttttgcgctgccgcttcaatactttctgaataaaaagccgaagagatttcatccgctgtattttctttattatttaggggtgtcgttcattgcaaacgggatcatcttcggtcttttgcagccgtcaggccaatctctgttttctaattcagccttttatatctttgcggttttaacagccgtcgtctattgggtgtgggattccgtattgctgcaaagacaaaatccggctacagaagcgtaatcagcagacagccggctgaagggagagcggcgcaaaagaaaacggcggccatctttaaacgggcgtgccgtccttcttctgtttcagaatgataattggcccgctgctccgctccgcttacggccagcccggaaacgatgaccgctgcgacgataagaacagccgtaacggcgccgaaaatgatgtcaaagccaaacggcaggacaaatccagccgcataagctgcggcggcgagtatacatccgaaggcgaacgcttttttcaaggcggatgcccctttcattttctttccattgtaacaaaagcccgccgtgtgcgtcaccggcgggcttttttcatgatgtgatgaccgcggatacggttctgtcttttccgttgatgtcctgtacgacttccacttccgcattcggaaaggaatgacggaacaggtctttcacggcttttccctgattatatccgatttcaaagacgacaagcgctttatctttcatgacaagaggcagctcctccataaaccgcttgtagaatttcaaaccgtcaccgccgtccgtaagagcatgaagcggctcatggaaacggacgatatccgacaaatccgccatttcttcttcagaaatatacggcggattggaaacaataatatccgctttttttcctgatgaaataaaaggagttaacagatctccctgcaaaaagcacacgtccgctccgaggttttgcgcatttctttccgccacctgcagcgcttcttttgaaatatccgaagccgatactgaaaaatgtccgcattcaagcgcgagcgtcaccgcaatagctccgctccccgtaccgatatcaatgacgttcagtcgttccgccccggaaaatacccgcttctgtctgtccagcagatgaaagacgacttcttccgtttccggacgcggaatgagaacatcgtcattcacaaaaaattccctgccgtaaaactgttctttcccgataatatattgaatcggaataccttctttatgcatctccacgtgccgtctgaaacggtaaagttcgtcctcgccgacgggctcctgcagacttgcgagaagtttgctccgatccattccggtatcatttaacagcagcagctcggccgcgtttttttctcttcccgcttcggttaaataagaagaagcccagcttagggcttcaaaaacggtcttcatcttaattttccgcctgctggagcttgcttgactggtcttctacgattaacgcttcaaccacttcatcaagcttgccttccaggatttgatccagcttttgaatcgtcaggccgatgcggtgatccgtcacacggttttgcgggaaattgtatgtgcggatacgctcggaacggtcgcctgatccgacggctgatttacgggtctgatcatattcagcctgagcttcctgctggaatttgtcatagattctggcgcggagcaccttcatcgctttttctttgtttttaatctgagatttttcatcctgacaggatacgacgacaccggtcggtaaatgcgtcaggcgtaccgccgacatcgtcgtgtttacgctttgtccgcccggtccgcttgatgcgaatgtatcgacgcggatgtctttttcgtggatgtccacttctacttcttccgcttcaggaagacacgccaccgtcgccgtggatgtatgaatacggccgcctgattccgtttccggaacacgctgtacgcggtgcgcgccattttcatacttcagcttggagtatgcgccttttcctgtaatcataaagatgatttctttgtaaccgcccgttccggtcacgtttgcttccatgacttcagtcttccagccttggatttcggcgtaacgggagtacattctgtagagatttcccgcaaacagcgcggcttcttctcctcccgctgctccgcggatctccatgattacgtttttgtcatcgttcgggtctttcgggatgaggagcactttcaaacgctctgataaggtttccgtctctccctgcagttcggagatttcttccttcaccatttctctcatatcggcatcaagcttttcctcaagcatcgctttcgcatcggcaagctgttctgatgcgtctctgtattgtctatagacttcaacggtttcttgtatatcagattgctctttcgaatattctctaagctttttcggatcgttgaccacttccggatcacttaaaagctcatttaatttttcgtatcgttgttcaattgactgtaaacggtctaacacggtcttcacctctgttttcctgtgcgtaacattctcattatagtatagggcttatcgccagtcaaaagcaattcgcctctgttatactgaagcaaaaaaggaggggcggatatgctgaaatccatccaccatatagcaatcatatgctctgattatgaaaagtcgaaagctttttacaccgagatactcggtttcggcattataaaagaaacatatcgaaaggaacgggaatcttataaactcgatctggcgctggacggcgcatatgcgattgaattgttttcctttcccgatccgcccgaacggccgaccagaccggaagccgcgggtctccggcatctcgccttcaccgtaaacgatcttgaagcagccgtcagggagttaaaggaaaagggcgtcggcacagaaccgatcagaaccgatccgctgacggggaaacggtttacctttttcttcgatcccgacaagcttccgcttgaattgtatgaagcgtaacgttttttgaagaaatgccgctttctttggcgaattccttcttgttttgtctaacgtgaagggaacgccgcctcatggtcgaatacctagcaaaaaggaggtatgtgatcatgaatacaaacatggccgcgaaagagctcggtgtctccgcaaaaacggtgcaaaggtgggtcaagcagctgaatcttccggctgaacggaatgagctcggacattattcctttacacctgaggatcttgatgtgctgaaatcggtcaaacggcaaatttctgaaggcactgcccttctggacgttcaagtgccccggcagccgaaaaaacggacgggcttcattttgcagcgtccgaaaatcactggcggcgctgaacaaaggttggcagagctggagcgcaaactggacattctcacgaaagagaaacaaggtgagaaccatctgctttcaaggatagaggagctggaacgccagctgaaacaaaaggcggatgaaggggtgtcttatcagcttcttcagcacagacgggaaattgacgacctcaataccgaattgcagacattggcctcccgcatccaggaacttgcccagacagctcccctctcagaaacagccgcttcttcagaacataagaaacccagaaaaaaaacgagattttcgccttttaaatttcaattctaatcaaaaaagctccctgaaacagggagcttttcattatgcagtcagcgcaatgatgatcggcagtgagatcagagataaaatcgcactgatcacgaacgcggacgcagtttcttcctcttgtttttcgaaacgtgtggcaatcatcgccgctaccgcagatccagggaatgcaacgagcaataccgctttcgtgatctggtcagccggaagtccgactgcaagagcgatcaagtacatcagcgcaggctgaacggcaacttttaacaaagcgataccgaaagccggcagactgagcttgatgttacggataccgacagttacaccgacggcaaagagtgcaacacctgatgttgtgcttccgagctgatcaagcattttttcacccaagccagggagtgttacaccgcagagtaccaggatgatactgataagcggtgcagccgcaagcggttcggaaagaccgtgaagaatagacttaccagtcattttccagaagttctcgttttcgctgtcttgtttcttagatgactcaccgactgtagcgataatgatcgcaagcgggtcaaggatggcgttaaccacgatacccgtaacggcgataggaatcgctacttcgtttgctccgaataagcttccaagtaccggaatacccataaatgcaaatgtcggctgtgcagagtttaaagaaaatacagatgaattcgttaaatcatacttgaagataaatttgcaaaccaacagaatgacgataaagaatccgacaatcccaatgatcaaagcgatcatcaaaggaacctgtgataaaaacgcacttcttgaagtggttaaaatacttgcgataaaatgcgccggaagcgcgtacttcgtaactaaggtgcttaccccttttgctgacttcgcgtcataacttccgaagcgacctgcgaaccatcccagcacgatcacgaaaaagatcggcgccaggaggattaaaatatctaagaagctcaaaatattctcctccaaatccttaatgtccgtatactttagcctttacataaaagctttccctcggactgtaaaattaatcgtaaaattatttagcgataacttgtttatattgcggtttccacattgcatcaagaacggcttgttctacattttcaggaatgcggtttgccacgccttctttaatggcagtttccgctacggcgatcgcaactttaattgaaacttcttgtaagtcgctcatgctcggcagaaggcctgcacccggtgtttcaaaatcaacgctttctgcgattgcgtcagcagttgccgcaaacattgcaggagtaatcactttcgcttctacaacgattgaaccgagaccaagtccagggaacgcgaatgcgttgttagattgtccgatttcataagaaacgccattgtactccacattgtcaaacgggcttcctgtcgccacaagcactttgccgtcagtccatttgaaaagatcgctaggaacggcttcagcaagcggtgtcgggttagacatcggcatgatgaccggacgctcaacgtgttttgccatttctttgacgatttcttcactgaatgcgccgctttggcctgatgtaccgattaagattgtcggtttcgcttgacggatcacttcaatgaaaggaatttgtccgttttcatcgcgtttccaatctttaatttcttcagctgtgcgcaggtacggctcttggaaatcaagaatgttttccataccttcaattaacaagcctctgtagtccattgtgtagaacgctttgttggcttcttcttcagaaagaccggcgagcaccatagtgtcgcggatttggtcagcgattccgattccggcagatcccgcaccgaagacaaccacacgctggtctttaatagacgcgcctgttttcttcatagccgcaagcacacctgcaagcgtaatcgcgcctgttccttgaatgtcatcgttgaaggtaagaatttcatggttgtatttcttcatgatattgcgcgcgtttttgtttccaaggtcttcccagtgaagaagagctttagggaaatatttaagcgcagcttttacataagcgtcaatgaaagcttcataacgttcgccttggatacgttcatggcggttaccgatgtataaaggatcgttcagaagtttttcattgttcgtaccgacgtcaagaacgacaggaataacacggcttgggtcaataccggcagccgctgtgtatacggctaatttaccgatggcgatgttgataccgcctacaccccagtcaccgattccgaggatgctttctgagtctgtcgcaacgatcagatcaatatctccggcagtggcatgaaggttttcaaatgcctcttcaattccttccacgttgtcgatagaaaggtaaatcccttgaggtcttctgtactcatggctgtattcttgaatcgcttcaccgacagtcggtgtgtaaacaaccggcagcatttcacgaagatggttttgaagcaatttaaagaaaagaacttcgttacggttttgcaaatcattcaaatacacgttttggcgaaggcggtccggctgagcttgaaactgctcgtatgcgcgttttgcctgctcatcaagagacagaatggtcggaggaagcagcccgtctaatccaaggctttttctttcttctgctgaaaacgcaacacctttatttaaagtagggatagatagaacttcttttcctcttaaagtagtttctaagttgccttccttcgttactttaatattattcaagaaaatctccttctttcttcaaatagttaacaaagttaagtaattacccattttggctagtgtgatcgcgatctgctatatctttttttgacaattattcgaacaatgtctcataactatttacattacttagtcattttatgcctgtaaaaatgaaaattcaagagatgaaaattacttaattttttcatactcttttttaagttaattaactacaatttttgaaaaaccgtcaaaaaaacaccggattttttaccgatgttttcatgaaaagggttatttatcagtctgttttttcggcacttcgtgatgatgtctgcatctcgcttcgtatgactccgacgcgccgactaaaatgaccggatcatcataggaagcgggcttcccgtcaatcaaacgctgcgtacggcttgccggcgacccgcaaacggagcagaccgcctgcagcttcgtcactgattcggcaaccgccatcagattcggcaccacgccgaacggctctccccggaaatccatatcaagtccggccgcgatgacacgatatcctttatccgcaagcgaggataagtcgccgatgatcgattcgccgaaaaactgcacttcatctaccgcgatgacgtccgtgctttcactgatatgatcccatatttcagccgaagacgagatgacgtggcttgtcatggatgtgccgttgtgagaaacgacagcctcctcactgtagcgattatcaatggcaggtttgaacaccttgacctcctgcttcgcataagtcgctcttttcactctgcggatcagctcttctgatttcccagagaacatgctgccgcatatcagctcaagccatccgctttgcttcattatgtacataggctatccgctcccctttttttcctgtttatggacataaaaaacaggcaagaagcaattcttgcctgcctgtaaaatctattattacttaagaccgtattttttgttaaagcgatcaacacgaccatcagcagaagcgaatttttgacgtccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattattccggagcgaatccggaacgcatatgagagaattatatcagtcatttactgcatttgcaaatacattttttatcagcggcgggctgatgatgaaaggtttgcctgcttccattcttggttgatcagatcgaagaattcctgattcgtttttgtttttttcatttttctcataaacttctctgcgaagtccggagaatcagacatcgatttgcggattgcccatagacggtcaagatgctctttcggcacgagcagctcttccttccgcgtgccggagcggcggatatcgatcgccgggaaaatccgtctttccgcaagagaacggtcaaggtgaagctccatgttgcccgttcctttaaactcttcgtagatgacgtcatccatccgggagcccgtgtcaacgagcgccgtcgccaaaatggtcaggctgccgccctcttcaatgtttctcgcggcaccgaaaaagcgcttcggacgatggaacgcagccgggtcaatcccgccggaaagcgtacgtccgcttggcgggataacgaggttgtaggcccgtgccaggcgggtaatgctgtccatcagaatgataacgtcttttttgtgttcaacgagacgcatcgcccgttcaagcacaagctccgctaccttaatgtgattttccggcacttcatcgaacgtcgagctgacgacatcgcccgctacggaacgttcaatatccgttacttcttccggtctttcatcaattaagagaacgatcaattcagcgtcaggctgatttgtcgtaatgctgttagcgatttcttttaacagcatggttttaccggctttcggcggcgccacgatcagaccgcgctggccgaaaccgacgggagccatcatatcgagaattcttgttgagagataattcggtttcgtctcaagcaccatttggcggtccggataaagcggtgtcagcgcgggaaaatgaacgcgctctttcgcagattccggatcgtctccatttaccgcttcaacgtgcaaaagtccgtaatagcgttcgttttctttcggcggacgcaccttgccggatactttgtcaccgtttcttaaatcaaagcggcggatctgggaagcagaaatatagatgtcttctgagcttggcgagtaattaatcggtctgaggaagccgaatccttccgattggatgatttcgagcacgccttccataaacagaagatcctcctgctcggcgttggctttcaggatggcaaagattaattcttttttagtcagtttgctgtagtaggagattttataatgtctggccagttcatatagttcttttaatttcatattttccaaagaggaaatagatacgtctttcataaaaacaccacgcttttcatagtcaatgtattgctgttttcattcaaatcggctgcttcgcatgattccgccaaagcacattcttttataaaacgttcaggaacttctatcggtaacacttccacccatgatcggcgcttttttaaaaaaggaatgtcttaatgagttttgaaggaagcgaggacaaaaacttgagaagatcaatatttatatcgtctgtatgcggtagaatttgaaaatttcccagtactcaaaagaaggaatgacacagaaaaatcgcagcactctttatttttacctcatttcaaaaaattattcaacttaaataatgctttgacatataaatgatagggttgactcttttttgcaaaagaaaagcgggactttccgtcccgcttttctctatttatggccggatcacaagatttggttttttcttcaggctgtgtcttccgtcaacgaatcggaccgttcctgatttcgcccggatgaccaggctttcagtcgtgccgacggagcctttgaactgaacgcctttcagcagctctccgtccgtgacgcccgttgcggcaaaaatggcgtcatcccctctcacaaggtcctccatccggagcactttggatacatcaaggcccattcgctcacagcgcgcctgctcttccgcactttgcggcagaagcctgccgatgatttcgccgcctagcgcttttaacgcaacggcagacagcacgccttcaggagccccgcctgaaccgaagagaatgtctactcccgtatggtcaaaggccgtattgatggcgcccgcgacatcgccgtcgttgatcagtttgattctggcgcccgcctcacgcaattcagagataattttttcgtgtctgtcacgatttaaaatggttgccacgacatcttcaatgtctttatttttcgctttcgcaacggcttttaagttatcaatgacaggcgcttcgatatcgatgcagcctaccgcttcgggaccgaccgcgattttttccatatacatatccggggcgttcagcaatgttccatggtcagcgaccgcgatcaccgtcagcgcattccagccgccgctcgctacgatgtttgtgccttcaagaggatcgacggcgacatcgacgcgcgggccgtatccgtttccgagcttttcgccgatgtaaagcatcggcgcttcatccatctcgccttccccgatcacgaccgtgcctttcatcggcaccgtgtcaaacacgtcacgcattgcgcttgtcgccgcatcatcagcttcatcttttttcccgcggcccatccatctggcagatgctaaagccgccgcttcagtgactcgaaccaattccatcgataagcttctttccatttcaacacgatctcctctcaaaagtccgcatttctatgaattttggagctgttctatctcttcgtccgtcagcctttgccgccagattgtggcgcccagaccttcgagttttttctcaagattgctgtagccgcggtctaaatgctcgagaccggtaatttcggttacgccgtcagccatgagtccggcgacgaccagacaagcgcctgcacgcagatcgctcgcctttacttttgcgccctgaagctcggccggaccggtgataatggccgacctgccttccactttcatattggcccccatccgtctcagctcatctatatgtttaaatcgggccgagtagatggtgtcggttacgacgctcgtgccgctggctctcgttaacagagatgtcatcggctgctgaagatcagtcgggaatcccgggtaaacaagcgtttttacgtcgaccggttttatctgcttctgcccgccgagcataagaagctgatcgtcactcgtctcgatgtaaaaacccatttccctgagcttcgccgttaaagactccaggtgagtcggtatgacattatcaataatgacttctttccccatcgcggcgccggcgatcataaaggtgcccgcctcaattctgtccggaatgatcgtatgcctgcatccgtgcagctcttttacgccgtcgattctgattacattggttcctgcgcctttgatctttgcgcccatgctggtgagcaatgtggcaacatcaataatctcaggttccttggcggcgttttctatcacggttttaccttcagccagtacagcggcaagcatgatattgatcgtcgctccgacgctgacgacatctaaataaatccgtgcgcctctcagcctttcggcgcgcagataaatcgcgccttgttcattggtgacttccgccccaagcgcctcaaaccctttgatatgctggtcaatcggccgcggcccgagatggcatccgcccggcagtccgatgaccgcctgtttgaagcggccgagcatcgcgcccattaagtaataggaagcgcggagttttttcactttgccgttgggaagcggcatgctgatcatcggggaagggtcgacgacaatttctcctttttcaaaatggacgtttccgccgatttctttcagcaggtcacgcagcgtttcaatatctgagatctccggaagcccttcgatcgttacttcggaatttgccagaatggttgcgggtatcaatgcgacggcgctgtttttcgcgccgctgatatgtacggttccgtttaacggatcgccgccggcaatattcaacttttccatgatagtctccttccataagaagatagctgcggagcgtaaataaaatggcattttattctgtctctgcaaataaagctcttgtccaaaatgtagccaattcgaagagaaagaatacaaggacattataaaataacaggaagaaaatagcgaagctttgcggggcatttttaacacaggatgcacagaggcccgccgggttcatattccggggaaacacactcttcactttgatactgaaggcccgctgccaaacaggaaaacataagggtgcggcaaacggatgcaaccggtttgccgcccttttcccccttatttattccagtcagccaagaattgctcaatgcctttatccgttaacggatgtttcgtcagctggtgaatgactttcagcggcatcgtaccaatatgcgcaccgcgtaaagcggcttcagtcacgtgctgtgcatgacggatggaagctgcgatgatttgtgtatcaatgtcatgaatgtcaaaaatctgtcttatttctgaaatcagttcaagaccgttatggccgatgtcatccagacggcctaagaacggagatacataagtcgccccggctcttgccgccaaaagcgcctggttggcgctgaaaatgagcgttacgtttgttttaatgttcaggtcgctcagcgcttttacggcttttaacccttcagacgtcatcgggattttcaccgtaatattcggcgcgattttcgcaagttctttaccttcttcaatcatttcttcagcattcagggaaatgacttccgcgcttactgatccgctcacgacttccgtaatctcacgaagtctgtcatggaaagacacgtcagcttctttcgccactaaactagggtttgtcgtaactccggcaagaacgccaagttcataagcttctttaatctcgtcaatgtttgctgtatcaatgaaaaataacataaggaaagcctccccagtaataaattttcagaactgtaaaacatgattgcgctttctaaaggtaagacataaaaccgcctgtcaatgctgtcaggcggtttatggatgttacattgaattaagcttggtttgaagaaccgaactcacgcattttgccgataaccgtttctttgattgcttcacgagcaggtccaagatatttacgaggatcgtattcgttcggcttagctgccaatgtttcgcggacagcttttgcagaagaaatttggttttcagtgtttacgttgattttagccgtaccaagtgagattgattttttaatgtcggcagtcggaattcctgtacctccgtgaagtactaacggaaggccggttgattttccgatatcttccatttctttgaaaccgaggttcggttcgcctttgtaaggaccgtgaacagaacccagtgcaggtgcaaggcagtcgatgccagtgcgctctacaagttcttgacactctttagggtcagcatagattacgccttcagcgatcacgtcatcttcctgtccgcctacagttccaagctcagcttcaactgaaacgccgtggaaatgagcaagctcaaccactttagctgtagttgctacgttttcctcaaacggatggtgagatgcgtcgatcattacagaagtgaaacctgcatgaatcgctttcgcacaagattcaaagcttgaaccgtggtctaagtgaatcgcgacaggaactgtcactttgtattcttccataagagctttaaccatggcaaccactgttttgaagccgcccatgtagcgtcccgcgccttctgaaacaccaagaataaccggggatttttcctcttctgctgcttgtaaaatagcttgagtgaactcaaggttatttaagttaaattgtccaacagcatatcctttttctttagctgtattcaacatttccgtcattgaaactaaaggcatgtcgaaagtcctccttatgtagcctgatttgcttcttctcgaaaaaagctttccacctatagcatgaccataaaaacctgtcatatgtaaaacaacagatcgctttttctccatctctaggataccaacttttcgacaaatcggcaacacaatgacataattgtttctaattttattaattcgattttagaggtaaatattttttcaccgcgtctctgatctcatcaatgtcaaaaggtttcgcaaaatgggtcagcgctccgagctcttttgattccttaatcatatcgagttctccgtaagcggtcatgataatgacgcggatggattcgtcgatcatcttcatgcgcttgagaatttcgataccgtccatgccggggattttcatatctaaaagcacgagatcgggccgttctttcgttacaatgtccagcgcctgtatgccgttggcggcctgaaacgtctggtacccttctttatgaaacacttcattgagcaatatgcgtataccgtattggtcatctacgattaaaatcttttcattcatcattttacaccccaatattatcattttcgtcaaaaggaagcagttgtttatgtattctgtttgattttcacatttcctttaattataatagtctactttccgacattttctgagcattttctcttttgttgtatactgttcttgtatgtgtaaaggaggtttcactcatgttaaagatatttacgacccagcttgcaggcattttttcccgcattcaggataaggaatccgaagcaatagaagacggcgcgcgcctgctggcgcaggcagccgtcagcggtcataccatttatttatacggcgcaaatgagatgcagggcattttgtgcgaggcggaactcggctcagaaccgatgccttccgtcaaagcgtttccggatacagctgattcggttacagaaagcgacagggtgctgatgttttgttcaggtccgggcacagctgaagaacaggcgctggctcaaaagctttatgaaaaaggggtcggcctcgtttgcgtatctcctgtcatcaaagatcaaaccgggattgaggaattttgtgatgttcatattgacagcaaattaaaaatgccgcttctgcccgatgaagacgggacaagatacggctttccttcattaatgacaggcctgtatgtctatcacgcgctatcctttacgttaaaggaaatgatgcaggaatatgcctgatgcagaaaaaagacttgccgcttttaaaggaggcaagtctttttttattacttctgttctgcagcttgtacggaagcgccgataaagtctttgaataaaggctgaggtcttgtcggtcttgatttgaactcagggtggaactggcaagcgacataccaaggatgatctttcagctcgatgatttccacaagacggccgtcagggcttgttcctgagaacacaaaaccgttctcttccatttgctgtctgtattcgttgttgaattcataacggtggcggtggcgttcgtataccacttcatccgcatacgcttcgaaggctttcgtgtcttcctgaagcttacaagggtacagtccgagacgaagcgttcctccaagatcctcgacatctttttgttctggcagaaggtcgatgatcggataaggagtggacggatcgatctccgcagagtgagccccttccagacctaatacgtttcgcgcatattcaatggatgcaatctgcataccgaggcagatgccgaagaacggaattttattctcacgcgcatacttggcggcgatgattttcccttctacgccgcgatccccgaaaccgccgggcacgatgattccgtctgtgccgccagtcagctcttgaatattgctttctgtcacttcttcggcgttaatccatttgatcttcacatcagcgtcaaacgcatagcccgcgtggcgcagtgattcaacgactgaaatgtaagcgtcctgaagctcgacgtatttaccgacaaggctgattgtaatggttttagacaagtttttcactttcgtgacaaggtctttccattccgtcatatccgggtctttgcattctaatttcatatgatcgcagacaagcttatcgagtccctgctcctgaaggttaagcgggatggagtaaaggttgtccgcatcttcgcactcgatgaccgctttcgtgtcaatatcgcagaagagcgcgattttatctttcatatcttgagaaatcggcatttccgtgcgcacgacgatgatattaggctgaataccgaggcttctcagctcttttacgctgtgctgcgtcggttttgttttcagctcgcccgccgctttgatgtacggaacaagcgtacagtgaatgtacatcacgttttcatggccgatgtcgcttttcatttgacggatggcttcaaggaacggaagggattcgatgtctcccactgttccgccgatctcagtaatgactacatctgcgtttgtttctttgcctgcacggtacacacggtctttcagttcatttgtgatgtgcggaatgacctgaaccgttccgccgaggtagtccccgcggcgctcttttttcaatacggcagaatagattttaccggtcgtcacgttgctgaatctgttcagattaatgtcaatgaaccgctcataatgccctaagtcaaggtcagtctcagcgccgtcatcggtaacgaatacctcaccgtgctggtacgggctcatcgttcccgggtcaacgttgatataagggtcaaatttttggatggtgacgctcatgcctctgtttttcaaaaggcggccaagtgatgctgccacaattccttttccgagtgatgatacaactcccccggttacaaaaatatatttcgtcatttcgtttgctcctctcttcggtctgcgctacattccttaaaatgtgccgttttatagaaaatcatttcactaaaaacaaatgatgtgtaaaagaatttgggagatgaaaataagaaagctccctttcaatttcttgaaagggagcgtagcactcttatgaattctcttctttttgaagagcccaaaatacatactacatagttcgacaatgaaagtcaagatcgttttgctgatataaaatcagtctttgcgatcctcttcctcatcatcataatcttcctcatcttcttcaatcatctcatcttcaatctcaagctcgtcgtcatcttcttcatcgatatcttcgtcgtcaaagctgtctgcgtcaaggtcaatatcttcttccatttcatcgagatcgatgtcatcttcatcaacttcctcgaattcatcaaggtcgagatcttcctcaacggcttttttcgcttttttctttttcgcttttacagtcggctgtgtttcttcgtccagctgatcgtacggataccagctgcggagcccccatgtctgatctgacagagcaataaagcggccgtcaatgttgaggtctgtataaaattgggcgatacggtcgcccagttcctctttcgtaacaccgagcaaggagatcatttcattcagcagctcctggaacggaaccggttttttatgttctgagaaaatttcgtgagcgatttcaactaaagccatctgcttcagctgttcctgagaatattgtttgatactcaaggtcggacactccctttctattacttatatgtatctgtttctatcctataataagaacgaatttgtattgttttgttcataaaccatacctctcattataaacaaattaaaacagaatatgctaccctaaacagcgtaatttaagaaattttagagccgccccttcataaatcggctgatgtgcgaaaacaaagccgccggcatatgcgccggcggcccgcttctttctataaagactcttgtttttcggcgccgaatacagacatggcgagcaattcactgacatcataagtgccgatcgcgtcttcggcttctttcgctttcgtcccgtcaccgagcatggtcagacagtaaggacatccggagctgatgaccgtcggactgacagaaagcgcctgctcagtccgggccgtgttgatcctcgctcccgtttcttcttccatccacatgagccctcccccggcgccgcagcacatcccgttttcgcggctgcgctccatttccttcaattgaacgcccggaatggcttttaagatcgctctcggcggctcatacacttcgttgtatcttcctaaatagcacgagtcatggaaggtaatcgtttcattgaccgggtgaagcggttttagtttcccctgtgacacaagctcggctaataattcagtatgatgatagacttcggcccggaatccgaaatcagggtattcatttttgaacatattataggcgtgcggatcaattgtgacgatttttttgattccgtgtttttcaaattcgccgatgttgtgttccgccagctcttggaacagaaactcgttgcccaaacggcgcggcgtatcgcctgagtttttttccttattgccgagaatcgcaaaggatacgcccgcttcattgagcagctttgcaaatgagacggcaatcttttggctcctgttgtcgtaggaacccattgagccgacccaaaacaaatagtcgaactctttgtcttgttttttcatttctttcactgtcggaatctctgtatcagcctgctcccgccagttctcccgctctttccggtttaagccccacgggtttccctgtctttcaatgcttgtcatggcccgctgcgcgtcgctgtccatcttcccttccgtaagcacaagatagcggcgcagatcgataattttatcaacgtgttcattcatgaccggacattgatcttcacagttgcggcaagtggtgcacgcccaaatctcctcttccgtgatgacctcgccgattaagctcgggttgtaatcaatggctgccgccgcttcacgcgatcctccccctgaggaagccgcggcgagctgattcgccttcgtgtgctgaaaaacgggcgcgggcacccacggagattttgatgtcacggcagcgcctttttccgtcaaatggtctctgagctttaaaatgaggtccatcggcgagagcattttgcccgtaccggaggccggacacatatttgtacagcggccgcattcgacgcaggcgtaaaggtcgacaagctgagagcggcggaagtcttcaatctttccgacgccgtagctttctttcgtctcatcggtaaaatcgattttttccagctttccttttgaatccagcctgctgaggaacacattcgccggacccgcaattaagtgcgcatgctttgattgcggcacgtacactaaaaagctgagcaaaaacaacagatgaagccaccatgaaacataaaatacggcggcggccgccggcgctgaaagacccccgagcacaaacgcaatggaggaagcgatcggttccgtccaagacagagaatgatcgtgccataaaaggttcatggcgttcccgagaagcaccgtcaccatcagtcctccgataaacagcaggacaagccccgctttaaacccgcgtttcaatctgacgagtttttcaatgtagcgccggtaaaacgcccagactacggcgattaaaatcagaaacgtaatgatttcctgaaaaaaggtaaacgccggataaagcgggccgaacggcagatgccggtcaggaagcagccctttcagaataaaatcaattgcgccgaactgaacgagtataaaaccgtaaaaaaacagaacgtggatgattccgctctttttatctttcagcaattttttctgtccgaacacattcacccatatcttatgaagacgttctttcaggcgtttatcaaattcttccctttggccgagcttaatataagcgatcctcgttctgatcaggtaaatgaataaataaacggcgtaagcgtttacagctgaaaacagcagcgcgtttaccatgagaaatgcgttcatcttgtctccccctttgttctgattcccctcttcattgtcatatctttactttatcataaataatgaatgagtgttcagtcaataattaaattcacattctcagggcacactacggatacttcggaaaggagcgtcggtatgaaggtcatttttgtgttgcttgtcatttttatcatattgatcgcacttatgctgtttgatatgctgcttggccgggcggcgtacaaaaaacaggcgtatgagcccgtttttgacccgaaaaagagtaatatcacactcattcactgcggcagcgagcttgtgcagcagatgacggctgatatccgccaagccgtctcttctattcatatgatgttttttattatgaagaacgaccaagtcagccatgagatgtttgatttattgaaagaaaaggcccgggccggcgtctccgtatatctgctgctcgattgggcgggcagccgccaagtgaaaaagccttccattcaaacgatgaaaaaagccggcgttcacgttcattttctaaataaaccggcatttccgtttctttttttcaggctgcaaaaacggaatcaccggaaagtgaccgtcattgacggcaaaatcggctatgtcggcggctttaatatcgctgaagagtacctcggcaaaaaagcgaagttcggaaactgggaggattatcacctgcggatgaccggcgaaggcacggcggatcttcagactctttttgtaagcgacctgaaacgaaataccggaaaaacacccgaatcacccggggtttatccggcattatccgaaggggatatctctcataggacatatgcatctgacggtttttcgcttgaatcgcattatgaaaactgcatccgtaaggcggagaaaaaaatcatcatcggcacgccttattatgtaccgagcaaaaagcttcaggaagcgcttatttcagcctgccgaaaaggcgtcaaagtcatcttgatcgttccgatgaaatcagatcacccgctcgttcgggaaacagcttttgcctattatcccgagcttctgaaggccggctgcctcatctatcggtattatcaaggcttttatcatgttaaagccttcattatagatgaccgcatcagcattatcggcacgccgaattttgataaacggagcctgttctggaatgaagaggtgaatgtcatcattcatgatgaagactttacaaaggaagtgctttcaaccataaagcaggacatcgaaaaatccgagcttctcacattagaaaaagtgaaacagcgctccgtcagacagcttcctgcagaatggctgggaaaggccatatcttactttttataaaggagaaaccatatgctgttcagattcggattcgtcgcaaacgccatgtgcctttgggacgcgtcccccgccaaaaccttaacatatgcgcgctataccaagctttcccgcagtgagcggaaagacgccctgctttctgtgacgaaagcaaatcttaccaatacgctgcgcaccctccactatgcggtcggccacggcatccctttgtacaggttctcaagctcaattgtgccgctcgccacgcacccggatgtaatgtgggattttgtcacgccgtttcgccaggagtttcgtgagatcggcgggctggtcagaaaatatgacctcagaacgagctttcatccgaaccaattcacgctttttacaagcccgaaacgggagattaccgcaaatgcggtcaaggatatggcctatcattatgacatgctggacgcaatgggcatcgcggaccgttccgtcatcaacatccatgtcggaggcgcttacggtgacaaacaaagcgcgcttggccgtttccgcgtgaatctgaaagaacttcccgatgtcatcaaacagcggatgactttagaaaacgatgataaaacatatacgtccgaggaaacactcagtgtatgtgagcaagaaggcattccgtttgtgtttgattatcaccatttttacgccaatccgacagatgacgctgatttagatgacattcttccgcggatgatcaaaacatggcagcggatcggcttaaagccgaaggtccatctctcctcgccaaaatcagaatcagccgtacgcagtcatgcggactatgtggatgcgaattttattctgccggtgctggagcggttcagacaatgggatacggacatcgattttatgattgaggcgaaagagaaagaccgggcgctgctccggctcgtcgaagaattaagcgccatccgcggagttaaacgcctggcgggcggagtgctgaggtggaaggtataaccaggtttatcacccgttcatatggggaatttccgaaataacagaccatcagacggaggagaaaacacatgaaaaacattacatctttgaaaatagccgctaagaagttcactttaagaaacatgcttcagctttatcagctttgccacacgggaggccacgagctgtatatctactctaaaaaaacaatgtgcaaaatcaaagatatcattgagctggaaacgttcagaatggctcataaagaacaagaatatttaattgtagtggaaggaaagaaagcggtgcagcttgttgaccgtttcaaacatatcatcgaacctgcgcaaaaagaagcccattaaatacggactacataaaaaaggatagacaggaggctgcccggcccccgctcgtctatcctttttccattattcatgtatcagctcgccgaattgggcctgatggagtctctggtacatgccgccggatgccagcagttccttatgatgaccttgttcagcgatgccttctttcgtgacgacgacgatcctgtccgcatccttaatcgtagccagccgatgggcgatcacaagcgttgtgcgtccttcagacagctcttgcagcgatttttgaatggcggcttccgtttctgtatcgagggctgatgtagcctcgtctaaaattaagatcgacgggtttttcaaaaacattctggcgatggaaagccgctgcttctgcccgcctgacagcttcacgccgcgctcgccgatcaccgtgtttaaaccgtcgggatacccgtttaccaaatcctctaaatgtgcctggcggacggcctgccggatttcttcctcagacgcatcgagccgcccataagcaatgttttcccgcaatgtgccggaaaacagaaagacatcctgctggacgacgccgatttgtccgcgcaatgatgacagcgtcatgtccttaatatcgattccgtcgatggaaatcacgccttcagacggctcataaaagcgcggcagcagacttgtcagcgttgatttccccgctcccgaaggcccgacgaatgcgactgtctccccggcatgaatggacaaattgattcccgacagaaccgggctgttttcttcgtaaccgaatgacacaccatcataacggatattcccttttaaaccggacacatgtctcgcgttcggggcgtccttgatatcaggctccgtttccattatttctataaagcttttaaaaccggctatgcctctcggatacagctcaataatcgcgttgattttatcaatcggacggaacagaacgttcgtcagcagcacaaaagcgacgaattctccgtaagataacgatccgcggatcacgaaccatgtcccgcacaacaggacgaacagcgtgacgaatcttgtcagcatgtaactgatcgagccgtttttcgccatgattttatatgacgtcagctttgttttgcggaaacgctgattgttcacgtcaaaccgctgcgtttcaaacgcttcattgctgaaagcctgaacaagacgaatgccgccgatattgttttcgaccctcgcgctgaagtctccgacgtctttgttcagttttgtaaacgcagaggtcatttttttattaaaatacaaagcaagccaaatgacgaccggcataataataaaggtcaacagcgcgagctgccagttaatgaacagcatcacaccgaacgcgcccaaaatcgtcatgaccgcgataaacaggtcttcaggcccgtggtgggcggtttctccgatatacatcaaatcattggtgagcttggacattaaactgcccgttttgttgttatcgtaaaatttgaacgaaagcttttgcagatggtcaaaaagctttttccgcatatcggtttcaatgttaatgccgagcatatggccccaatacgtcacaacatactgaagcgccgagctgagggcgtagactccgaataaagcagcggaagtcaaaataatcagacgccaatcccgccccgggagcaatgtatcgataaagtaatttacaatcagaggaaaactcagctccatcaatccgccggcgatggcagaaaagaagtcgagaaaaaacagctttttgtacggtttataataagaaaaaaattgtcgcagcacgattccgtcctccttgtgcctcgttcctaatgataatatttctcaattatactatacacaaggagttttaaaagcgttttttataaaacgccggaaaataaccgcgcgaaggattccttcgttctttcccataatgtgcgcttatagaaacggacggggctgattttctcagactctctcatatcctccagataatgcgcttcaagatctttgatcgccttttgatctgtaaaaaagacattaacctcaaagttcagctgaaagcttctcatgtccatgttcgccgtcccgacagaggcgaggtttccgtcagtgatgagcaccttttgatgcataaagcctttttgataggaatagacttcgattccttcgcgaagaagctcggggaaatacgatctcgtcgcgtactgggttaaaaatccgtcattggtttccggcaccatgactcgcacccggacgcctctggcagcagcctcctttagcgctgtgcggatcggctcattcggcacgaaataaggcgtcgcgatccatacagatgattcggccgccgctatcatggcataatacagatcgctcatccgttccttcatatcggggcccgtcggaacgacttgatagacgccgccgctttctgcagggaccgggcagctgtatgctttctgatcaatcagcacctcatccgaaacgtattcccaatcaagcataaaaatgctgtggagcgtctgaacgatttctccttcgactttcatatgggtgtcccgccaaaaaccgacactttggtctttgccgatatactccttgccgacattcagcccgccgacaaaaccggttttcccgtcaacgatgacgatcttgcggtgatttctgaaattgaatttttggttgaaaaaaccgtatttcagcggcagaaacgggacgatgttcacgcccgcgcgtttcagttttttaatgtcttttccggccagcttcaggctgccggccgcgtcgaacaaaaaccgcacttcaacaccttgacgcgctttttccatcataatctccatcatcttgtgcccgagcatgtctgatttgaacatgtaatactcaatatgtataaatgatgctgccgaccggagcgcttcaaacagctccggaaatgtttcgtccccgtttttgagcaccttcagcctgctttttgtattgatattcatatgagacgccttgattgaatattgaaagaaacgcttctgatttcctttcagcccggacagatcgggagtctgttccatatcaaatatcgttctcagcttttcccggttgtatgtccgtttcgacctgaacagcttgcctttttcataaagctggccggaaaaaaggtaaaataagtacccggcgatcggaaaaaacacaagaatatgaatccataacagcgtgtgctgcgaggtgcggttttcaagaattaacgaatagatgctgaacaaaataatgcttgcatagcaaagcaaccctccgtaaaactcaagcctggaaaccggaaaaaaccatatgacatatgctccgataagcatcatatataaaaagcaaaattccagtctccttttcagcatcccgactctctcccatctgatccgataactctgtataccctctgtcttccggcctgtaaacatatgaaaaagcctctccgcacgagccggaaaggcttatgatgacacttcctgtgactggccgggtgtgatgttctgaagcaatgccggattgagcgagcagctgcctttgattttatttttgaagatgccgatgatcagaccggtgaccgcaatcgacactaaggagaagagccctttcagcaatccgacggagaaaatgccggccagcacgacgccaaaatcgaagaggaaattaacggcacccggattccatccgcagcgcttttgcagaaataaagcgaggatattggcgccgccgagcgatgcctgatgataaaacatgagcgacaggccgaacccgatcagcgccccgccgcaaaccgccccggcaagcggtgaaacagagaccggcggcagccagtgatccgcgccggtaaacagagtcagcactgtgactgcaaaaacggtggatagagtgaatttgattcccattctgatgagagaaaatatataaaacgggatattgatcagaaagaagataatcgcaaacgaggaatgaaacaagtacgacaggcttagtgacagtcccgctgtgccgccggttaatacatgagaatgtctgagtgtcaggacgccggcgcttgtcatcagacaggcggctaaaatgaggaaaatccgcttcattcttcactctccttttgttgatattatttccacataaaacataacaggaatcaccgccgcccagccattaccttggcagaaaatatcttatgtttttattttttcaccataaaaaatccccctcttgcagggggatttttacgtgcgtttccgatagacaacatagctgcgggtcaaatacttgaggggcaggctgaacacgtgaaccaatcttgtaaacggccagaggataaaaacgacgtaccctatgatgatatgaaacttaaaccatagcgggacactctccatcaaagaagcgtcaggccggaacaaaacaatttccctgaaccacggcccgactgttgccctgtaatcaaatcctttcgagtcaatgttgagaaacgtggccgcaacgcccgacagcatcatgaacagcagcagaataagcgtcaggatatccgatggcgagctggttttgcggattcttttgtcaaacagccttctgtatgtcaggatcactagtccggcacaagccgcgatccccgccggcaggcctgcgccgatcgccattttgtgatacgtatgctctgaaatgccaagtgcagtatacacgccttccgggatcagaattcccatgacatgtccgccgacaacgaacagcagtccccagtgaaaaagtgtgctgcccgccgcaagttttttcttttctaacagctcgcttgatttcgccgtccagccaaactggtcatgctgatagcggtaaatatgcccgccgataaagatcgtcaataccatgtacggcataatcccccacaggatctgcccgctcatgcctgaacagccccttcttcagtgctttcacgtacaccgatgctttccagcgcggcctgcagcacgtgcagcagctcagcatagaggctgtcatttttttcgaggcgggaagccagctccctcacattggacaggtatttctcaaacacgcttctcgccgcttcaatttctgcgaccgcggcgaattccagcataagcggcagataatcaggcagctctttctctgtcggcaggaaaccggattgctggtaggtgttttttaaatgcagcagttcaattccgcgctccctttgctcgcctgagttaaagtaggtgacgtacatattcgtttttttcccgaagtcgaacgtatacacatagtgttcaatcagcgcttgcggagaaaagccggctgccgcctctaaaaagtgcagcagtttctcacggatttgctgattggtgacgtcatggataagagccttccaatcgggaagcccggctctccactcttcatccggataagagagaagaatggaaagagcggagaatgtgatttgccggtctgtggtgttcatcttgtttcacctcatttatcaaaagttagaaacaagagccggggccgcctgaaaatgacaaaccgcagcttccttgttcagcgtataaatcagacacttcttctcgatggctgctcgggatcacaaagcggtcatcatatttggcgatcgccagcagccgatacatgtcttcaatttgctgttctgttaaaccgacaccggagatcagtgccgcgtcgatggatttattcgtctggaccgccctcatatactgacgcatgacggacattttctttaacgttgaccgaatatgatccgtatcaccggccgttaataactgggccaaatagtcaatcggaattctcatttggtcgatagccgggaaaatatcttccgccgtttgccggctgccttttccttcaaagagattcataatcgggctgagcggcggaatgtaccaaaccatcggcagcgtacggtactcagggtgaagcggaagcgcaatcttccaatcgatgatcattttatagatcggcgattgctgcgcggcctctatccattcagccgggatgccttgttcttttgccaatttggcaatctcaggatcattcggatcaagaaaaatgtccagttgggaatggtagagatccttttcattttcaacggaggccgcttcctccactttatccgcgtcgtacagcatgacgccgagatagcggattctgcccacacacgtttcggagcagatggtcggcagccccgcctccaagcgcggaaagcagagtgtgcatttttccgctttgttcgtctgccagttaaaatagacttttttataaggacaggatgagacgcaatatctccatgaacggcacgcgttttgatcaacgagtacgatgccgtcttcctcacgtttgtacatggcgccggacgggcaggatgacacgcatgccggattgatgcagtgctcacaaatacggggcagatacatcataaagacctcatcgaattctgttttgatcgattcctccattttttgaacgtttggatcttcaagccctgtaatatggccgcccgcgagatcatcctcccagttcgggccccattcgatattcataaaatcacccgtcaaggacgatttcggccgcgccaccggctggtgctttttctgcggactgtttgttaatgtttcataatcatagttccaaggttcatagtaatcatcaatcgtcggctgattcggattatagaaaaggcctgcaagccggtttgttttcgggcctgatttcaattcaagctttccttttttcaacgtccagccgcctttatatttgtcctggtcctcccattgcttcgggtagccgatgccgggctttgtttctacattattaaaatacatatattccgcaccggaacgatttgtccacgtgtttttgcaggtgacactgcacgtgtggcagccgatgcatttatccaagttcatgaccatcccgatctgcgctttaatcttcaagccaatcgacctccttcagcttgcggatgacgacattcagatcgcgctgattccccgtcggaccgtaatagttaaagccgtaactgagctgtgcgtagcccccgatcatctgggtcggcttgacgtgaatccttgtcgggctgttatgggtgcctccgcggttattcgtcagttttgtgccgggcacgttgatgtggcggtcctgggcatggtgcataaacgccattcctttaggaatccggtgagacaaaaccgctctcgccacgacaacgccgtttcggttgaagcattcaatccaatcgttgtctttgatatccgtgtcctctgcgtcatctttattcatccacacggttggtccgccgcggaacagcgtcagcattggcagagaatcaaaatacatgctgtggacagaccatttattatgcggcgtcaaataattgaggacgatttcttttccctcttgatcaggccgcttgcttagaaacgggcgatgctggaggatcggtttgaatgtcgacatcgtttcaccgaattccatcatcagttcatgatcgacataataggattgtctgccggtcagtgtccgccacgggattaatttttccacattcgtcgtaaacggcgagtacctgcgccctcctttttctgagccggtaaaggccggagacgtgatgaccgttttcggctgggctgtaatttgctcgaacgtaaagcattcttcctcgcgttcttccgccaggtctttcagcttcaggtttgtgatgttttcaagcgattcccatgctttcacggcgacctttccattcgacgtggatgacagggttaaaatcgcttctgccgcctgtttcgcttcactgatattcggacatccctttgcgaggctgtccgaggtgatttctccaagtctctttttgagtgattcatattcatcggcgatagaccagctcatcccttttgttccgctcggttttaaagccgtatgagggccgagcgcggtcattttatgaaaaatgtgtttgtaatcccgttcaacgacatggatgttcggcatcgtttttcccggaatggcttcacattcgcccttgctccagtcattgatttttccgaacggctgggccaattcctgcatcgtgtcgtggaggagcggcgtcgcgactacctctttcaccggctccatctcgacttcttccgccagatcggaaacggcttttgacagcgccttaaaaatatcccagtctgacctcgattcccacggcgccgagatcgccggagcaaaaggatgaataaacgggtgcatatccgtgctgctgaggtcgtgtttttcataccatgtcgccgccggcagcacgatatcggaatacagcgccgtaccggccattcgaaagtcgagattgattaacaagtcgagcttgccttccggcgcctgttcccgccatttgatttcttcagggcggatgctgtcgctgtcgtcattcatcagaccgtttgtcgtccccagcagatgcttgagaaaatattcatgcccttttcctgagcttgagatcagatttgcccgccatacaaagagattccttgggaaattcacttcattgtccgggtcttcaatcgcgaatttcagttttttctcctgaagctgtgaggccacgtacgcacctacgtcttcaggtgtcgccgcccccgctttttcagcttctttgtacagatcaatgccgttttgattgaatgtcgggtaggacggcagccaccctaatcgcgccgccagcacattgtaatcggcgtgatgcttgtagcgggatgacgcggcgatcggtgaagccaagtcactgatcggctggtcttcataacgccactggtctgtcgcaaagtaaaaaaatgaggtgccgttttgcagtttaggcacgccttcccagtcctttgcggttgcaatcgtctgccacccttcagcaggacggagcttttcctgccccacgtaatgggcccagcctccgccgtttacgccttgggcgccgacgagtaaaacaagatttaacaccgcacggtaaatcgtgtcggagttgaaccagtggttgattcccgcccctacgataatcatcgatctgccgtctgtatcgatcgcattttgagcaaactccctggcaatctgtataacggcttctcttttaattcccgtgatctgttcctgccaggcaggtgtgaacggacggggatcatcataagatgcggctgattgtccgccgatgccccggttcacgccgtagtttgccaatatcaagtcaaacacggtcgtgacgtacgtctcttcaccattcagatccaattttttaataggaagattccgctcaagcactttgtttccgtcatttgaaaaatacggaatgcgcaccgtgccgatttcgtcctctattccgagcacggagagacggggctcgatctgttccccggtgtcttcgtcgatcatgtgcagattccatttctgctgcccgtcccagcgggagcccattgttccttgcggtatggcaaacgcacctgtctgttcattccagaccgccggcttccactgatcatgctttgtctgccgcccgatgtctttcgcatgcaaaaaccgccccgcagtatacacgcccttctcttttgacagagtgacgaagaatggaaaatcggtgtattgcttcgcgtactcaataaaacgttcagtttcttggttcacgtaaaattcctgcataatgacgtgccccatcgccatcgccagggctccgtcagtcccctggcggatgctcagccagtcatccgcaaactttgaggactccgcaaaatcgggactgattgaaatgaccttggcgcctttatagcgggcttccgccagaaaatgcgcatcaggcgttctcgttagcggaacgttggagccccatgtgatgatatagcctgaattgtaccaatcactgctttccggaacgtccgtctggtcaccccaaatttgcggggatgccggcgggagatccgcataccagtcataaaaactgagcattgggccgccgattaaagacatgaatcgcgaacctgatgcgtggctgatcatggacatcgccgggatcggagaaaaaccgacattccggtcaggcccgtatttcatcactgtatacagcagagaggctgaaatcagcttcagcacttccggccattccgcgcggacaaagccgcctttccctcttgcctgtttataggacttcgctttttcagggttttcaacgatcgatttccaggcatccagcggattttgatgcgtctgcaatgcttcccgccacaaattgatcagcacaccgcgcacatatggatatttcacacggagcgggctgtagatgtaccatgaaaaactggccccccgcggacagcctctcggttcgaaatcaggcatatccgggcctgttgatggataattcaagttttgtccttcccacgtgacaattccgtttttcacataaatattccagctgcaagaacccgtgcagttgacgccgtgggtggagcgaacgactttgtcgtactgccatctgtttctgtatacattctcccaatcacgatcttcgcttgtcgtttggctatgatgatttgaatgatgttcgataggagaaaaatagtttaatctcctgagcaacggactcattttctttttcttcatgatcgttcactccttccgagtcaggtgatgctatgtacactataaacagagacggcgcatcaccttgtgaactatgtcacacactctgcttttttcacaaaacgttcacacagagcagcaggaaggattttcaaacgatatagggacgcccgcgtcatcaaaaaaccggttctgtttaagaaccgggttcggcgttttcatcccgtgatgtatacagataccgcaaaaacaactgataggaacagaagacattttgctgaagcatcgccaaaaagttcatttgcagccgcggatggtaagacatcatttgcttaaatacggaatatggaatatggagtaccagaatatccgttgaggcattgactgagataaaaggcgataaagagagcccgcctttttcatcaatcggaaacacatcgcctttttcccacagcgcaacggtttgtgacccttcagggagcctgctgtccgtaaaacggatattgcctttcaatacaatataaacggattgtgaatgaagaaaggatggagattggtcagatgagccgcggataaacgtcccgtttttcagcaaggtttcgacaatggacagaggcacttcattaaacataggaagttgtttcagaaataataaatagtcacactgattcataggaaagcctcctgtgctattgatatctttagtgtagcccgattgagcccgcgcggcagtgatgtatttcacagcttgtatgataaaggtcacttatcaggagagtgtttgcacttataatgaaataaaaaggagggtttcgatgaaggcgatgattccgaagcagcacggcgcatgggcgatgctgctgattccatttttactcggcatggtcaagggaggcccggttttctggcatattccgctctttctgggctggctgttcctttacttgacggtttatcccgtttcgctcgctttgaaaaagaaacagcttcagccctatcaaaagtggatatggtattacggttttccggcctgctgctttttgatcatttctgtctttcataagccgcagctcgtctggatcggcgtttttttattgccgctgtttctcatacatacgcattatgcccgccgaaaaaacgaacgggcgcttacgaatgatattgcgggtgttctgttcttttgttcgggcggacttgcgagctgctggctgggaacgggaatccttgacggctgggcttggtttctattcttgcaatccgctttattttttgtcgggagttctttttatgtgaaatcggtcatacgggagagaaaaaacagaaggtttgcttactggtcgtggggatatcacctcttgctcccctttttatcggctcttctcggggcaggctgggcgtttctcgcttttatcccaagcagtctgcgggcctggttttttcacggaagagactggccggtgaaaacgatcggcattctggaaatcctaaatgccggcttctttttcgccgtcatgtgtatatgtatcacaagctgaaaaacaaggacatcggctgcccttgttttttcagtcaatattgcagatctcaagcggacaattttcacactcgatctcgcatcgtaaatagtcccgcttgtgcaaaataatttttccggtttcgtctatcgaaataaccccttgtttgcggaggtctcccagcatgcggttgacgctctcccttgccgccgcgcaaaacttagccaaatcctgatttgtcagcacaatgttaatcagaatcccgtcacttcgttccaccccgtagctgtttgataagcggataagggtggaatagagcgccccttttttgccgtgaagaagcagatccctgatcttagactggatttttcgcagatgggtgctcatccatttcataaattcaaacgtcaaaacaccgttttggatcaattccttttccagcctgtttttattaatgacgagcacctccccgtcctctaacactttcgcactgagcatatatctcggctcatctgtgaatagcgtcaattccccgataatatcgtgtttctggcagattctaagtgtcaggtcttttccgtcagacgtcagcttgccgatttcaatgagtcctgattgaatcagataaagctcttctgcatccattccttcttgaaacaaatacgtgtgttttttcattttccttttcgtactgatcgattccagcaattcatgcagttcgcgggaaagaagttctttatcagattttcggacagagagaatattcatgagctcacctcgaagaaagtcacgttgcgtatgtatattgtaacgtgacttgatttgcactcgcccagaaaaaattaacaatcttgtgaatggatcattatgaatcaaggctatgactgtttctctccgtatgtgttttcattctttcctgccaatacatccagatcacaaggacaaagctggctaacgcaacctctgaaagcgccataaacccgatcgcgtattgacccgttgcctgaaatacacttgccagaatcagcggagggaaaaaaccgcccagtccgcccatggcagacacaataccgttggcaatccccgcttgcttcgaaaaatagaaaggcaccagtttaaataccgtcccgtttccaatccctgagcagactgccaccgtcagcgatccgaacgcataaaggccgatcgccggggagaatgacagcatgacgcctgacagcgtaagccctgcgaaaacgaacatcagaatgcggagcgggctcagtttatctgcaagaaaccctcccacaggcctgagcagcgtagagaccgcaataaagccggccgtccgcagaccggcgtccgcagggctcagcccaaaatgctcaaccaaaaaattcggaagatagatggtaaaggcgacaaaggcgccgaacgtaataaaataaaacaggctcaacatccacagcacatgatttcggtaaacggctttcatttgtgtctttatggaaactttgactttcttctcatgccggtcgccgaacaaaacgtgcagtaatgcgaaaacagccagcaaaacaagatacatctgcacggttgctttccatcccgcggcttgagcgataaccggcgccgcaaaggtagtaacggcggtcccgatgtttccggcaccgtaaatcccatttacgacaccgtgcttttctttcggataatatttcgggagggacgtcactccgatggagaataccgctccgccgatccctaagaaaaagccgcccgcaattaaatcaaataaagaatccgcgatactgatccaaaatacgggaaacaaaagcaggatgaagctgatcataaacatcagccgcgcgccatacctgttcgttaaatatcctaaaggaatacggagaagcgatccgagaatcacgggaatcgccgtcaccaatgaaatctcgcctttgcttaaatgaatatctgatgtcatttgagaaatgagcgatgaaatcagcacccacaccataaaccctgccactaagcttaatgactgcagcgataattgaatatgttgacgattgatcattcggcttgcccctttcactgattcaatatcagtcttatcatacaaaaactcagtgtgcgggattgtgaattacatcacacgctttatatgcaaaaaaaagaacaaagcccgaagactttgtcctttgatcatcattacattttttccggagcggatacgccgatcagctgaagcgcattgttcagcgtaatttgcgtcgccttcattaaagcgagacgcgcgcggctcttctctttattttccggatcgatgactttctccgcattgtagaagctgtgcagagcggaagccagatcataaatatagtttgtgacacggtgaggaatgcgtttttccgccgcttctgccactgcttcagggaagccgccgattgttttcagcaggtcatattctttttctgattgaatatggctgaaatcaagatctgccgccggtttaagtccctgctcctccccttggcgaagcatgctgcaaatacgtgcgtgtgcgtattgcgcataatacacagggttttcattagatgttgatacggcaagatccaagtcaaaatccatatgcgtatcagcgctgcgcatcgcgaagaaataacggaccgcgtcaaggccgacctcttcaatcaggtcgcgcatcgttacggctttccccgtacgtttgctcatcttcattttttcgccgtttttgtataaatgaacgagctgaatgatctcaacttccaatgtgcctttcttgtaaccgagcgcttcaatcgccgctttcatacgcggaatatacccgtgatgatccgcgccccatacattgatgagcttgtcgaatccgcggtcaagtttgtctttatggtatgcgatatccggcagcagataagtgtatgagccgtcttttttgatcagcacacggtctttatcgtcgccgaacgttgtggagcggaaccatgtcgcgccgtcctcttcgtatacatggcccttttcgcgaagcgtctcgagcgcctgatcaatttttccgttttcgtacagtgacgtttcagaataccatacgtcaaacggcacgcggaaattttccaggtcggagcgaagtttatcaagctcgtactttaagccgtattcacggaaaaacgcctgacgttcgctctcctcttcatgtacgaaacggtcaccgaaatcttcggcaagttttttcccgatggcgataatatcctcgccgcggtaaccgtcttccggcatcggtttctcgaggccgagcgcttcaaaataacggacttcaacggaaagcgccaggttgttaatctggttgcccgcatcattaatatagtattcgcggctcacatcatagcccgctttagaaagcacgctgcacagcgcgtcacctaccgccgcgccgcgcgcatggcctaagtgaagatctcccgtcgggttggccgatacgaattcgacctgaatcttttcgccttgtccgatgtttgtctctccgtaatgttcacccgcttcaagcacggacggaatcagttttgttaagtagctgttgttcatgtaaaagttgataaagccgggtcccgcaatatccatcttttcaatggaagctttgcctttatcaaatgacgccacgatctcctcagcgatttggcgcggcgctttttttgcgattctcgccagctgcatcgccatgtttgtggaataatcaccgtgtgttttgtctttcggcgtttctaacagtacgcttggaatctggctttcgtccgccaggcccgctttcagaacggccgctttgatctcttccttcagcacgtccttcatttgttccgcaatattcatgcctttgtttcctccttatattggatcgtcatgttatgtacatgttcttggttttcgcctacagtcatgttatatgtcagtttgacggagccttccgaactgccgacatcagattgaatgtttttcgtttccgtacggagctccatttgtccgaacggcagtttatattgagtgagtgtcgatgcccccggaatgaaccgctgtttcatttggatggcgcccgatctcattacgagaatctctttttctgtgatcttgacgaccgttttaatcttgcccaaatcatgctcttcgtgataggaaagatacgttttgccgtttctcacgtaatagaatccactcgatgtaaattcaaccgactcttcttcagagccgttatgaatgaatgattgcacatgaatggctactggtgtctcctgtctcatgctgacacttccttttcatcatcccgcttaacctgaatagtataagttttcaagggaaaaagttcaaccgcttcctcctatcttaccatctttgctgattggttttgaagataaacatgatttttaaggaaaatgaaaaaaccggaaatcctaggctgcgggataaatgcggttccttcggcggacggctttgtcaaaggggaaaagtttgcggtatttttgcgctatccttccgaatgaaaatgataaaatatgtcatatacataacgtggaagggagggattcggaatagtggcgagtgttttatcgtcttcagcgattggagaaaaaatcaacgaatggtatatgtacattcgaaggttcagcatcccggacgccgagtatttgcggagagaaatcaaagaagaacttgcaggcctggaagatgaccaggatcttcatctgtactattctctcatggaattccgccacaatctgatgctcgaatacctcgaaccgctggaatcgcagcggatagaagaacagccgagactatcggatctgctcgcggatattgataaaaagcaggcccggctgaccggacggcttgattattattttaattttttccgggggatgtatgagctggaatgccgtgaatatctttcagcgattcagttttttaagaaagctgaatataagctggattttgtcaaagattgtatcgagaaagctgaattttattttaagatgtcagagtcctactattatatgaagcagacttatttttctatggattatgcccggcaggcttataaaatttatcataagcaggaggcatataatataagggtgcttcagtgccattcattgttcgctaccaactttcttgacttaaagcaatatgatgaagcaattcagcattttaaaaaagcttatgccatggcagaggcagaacagcagcctcaattaatgggccggactctatataatatcggactttgttttaacagccaaggaaattacaaaccagccattgattacataaaacgggcaatagctgtttttgaagatgggaacatcatcacttctctcccgcaagcctatttcttaatcacacaaatacattataaaatcggaaatatggccatagccagacaatatcatgacaaaggggtatcttatgcagaggaggcagaagattccctatatatagtcgaatatgaatttttagaatctttgtatgtcggtgagcctgatgaagaagcaatcatggaatgttttgactttctcagagataaaatgatgtatgctgatcttgaagattttgccttagatgtggcaaaatattatcatgaaagagagaatttcgagaaggctgctgcatattttttaaaggtggaagaaacaagacagcagattcaaggaggtgtgaagttgtatgaaattgaagtataaattagcacttacttgcttggcagtaagcactgtttttgtttcagccgacatcgcaagtgcaccggaacatcaatttgaagttgctcagcgcggaatgatttaaatgataattacttttaggcttgcaggttaaactgcaagccgttttttatataaacaactaatttacaaaaacaaaaaaaacataccttagaactcaaatgtgtaaaaagtatttgacacttatacatatattatttaaaataaatatatataaatttgaaaatttaaaataaaaaacaaaataagttaaggagggttttagtggataacaatataaaaaaacttagaacagcagctgatatttcacaaaatgatctggctaagctctgcaatgtgaccaggcaaaccatcaatgcaattgaaaataataaatatgacccgactttaagtctggctttttcgatagctcacgctttaaatacgggaatagataaagtattcaactataacgccaaaaaaaattaagggagcggttcttatgaagaaaatggatgagatgcaaaaacaccaatcgggtacagccgccagaatagcatttagtttttatactgtcgctttactgatatggtcattaatagattattttaaaaacggaaatacaggatggcaatttccgattcttttaataggctgcgcgctctatttatggattcaagtttatcaaaatcgaaaaacaaggtaacgattccaatacacttccggaggattatacagcaatgtacgaatacaagttcataaaagcagaagtaaaccgatggaaaggaaaacctaaagaagactataaataaattattgaaaagtattcgcaacaagggtgaaagctggttcaaatatttgctcctgctatttcaggctatggggcagccgactattttgatattatttttgaaaaaaagtataatgtttcagtaccaaagaaagccggatcatacatatggtccggctttctttgtacgaaataagccagcagatacttttacggatttcacctcttaactattattttttcggaaatccgcaattcaaatagattccaatatattttattatttaacttgctggggatattgaaaaaattggaggaaaaaatgaatctacttttaaaaacacaaaatagtaaagcgatttttacattagtagcatcaggaatcattgttctcgctcttttcagtatgaaacataatcatttaagcatggatgttatcgatattttaaacagagctggaattatcgctcctagttggattgtcagtgctatcaccgcaacgggttcagttctggctatcattactgttttaggatctcttggtgcgggcttgccattggccgttttagaacaattggctgcagcaagtacagcagcagcataatataaaacattaaattcaatatccctggcagtccctttaacgaatggatgaaaatacattgtttaaaaaagatgttttagtcaaattgtacatactctgtctgatcttatttttaattgctttatttacagcatatttttatacagattccgcttcaaatgtaaataatctaaatcgaaatatccgtccggatttttttcagattttctttaataatattaaagtagcgagtctgcttgtttttttaggcccgttgacgctgtcgcttggcacggttgctgttttaattattaatggattaattttaggaaatgcgataggaaacattaaagacaatttaaaccttttactgcttgttataccccatggaataattgaagtgccggtattgcttcttgcagcctctgtaggaatgaaattaactttagatttattactcctcaaaataaatttgaaattcacttttaaatatattggtattatatttctcggtttaatgatagcagctatgttagaaacatttattacacctatctttataaaaggagcctcttaagattatgcaaattgaattatcttcatttaaggaacgaaacattaattttttgtcctcgtttttgttttatattatcgggttagctttttatttaagttcccttttaccttttatgaaaagtttaattcccaaaaacatccctatacaagttgttgagcaagtaaaacatttagattacatcattgcaatagccgcactgtttcttttaatgttcggggtcatttttgaaggattcgtattatttctcattataaattttcttggcgctcaaattaagatcaaaactttttattccctatttatgttttctaacatcccggtcgcaattaagttttttcttatatcattcaaaaatattttcgcagaacatccaaacactagtttatttttcacaagtaatcatttgattttttctatctttgatttgttcaatattgcatatttatttcttttgtttattcttctgaaatggagaacaaatttgaactacctgacaatctcagtttttatttttacggcattcctgtatagaatgtttttttagcatatataaataaaccccctcaataggggtttttctttcatttcgttcactgtatacaattccttttatatgcttccgaaacaataccgactctagtactcacattccactttttacaaagaccggctatgatatattcgacattacgctgcgagtagtttaatgacttagcgatctctttattaggcttttcagcaattatcagtttaattactgaaatttcaatcttttttaattccaattcattttctactgctgttttcattccaacttcctttctaaagatgtatttactaaataataccctattatataatttttatcaataacatcaattattaatagtaaaataatatattgcttttactaacttctaaggagtttatatacaatataaaaatcccccgccatgtttcaagcgggggaaattctttctatttcacaaacccaagcagcatttcacggatcatcttgcttgccgtgtttgcggtttgttctgagtggtcatagaccggtgccacttctacgaggtcggcgccttttacgctgacctctgagcgcgcgatttcatggatggacgcgagcaattctttagacgtgatgcctcccgcgtcaaccgtgcccgttcccggcgcatgagcggggtcaagaacgtcgatatcgatcgtgacataaacagggcgtcccgcaagctgcggcagcacttttttcagcggctcaagcacttcaaacttagaaatgtgcatgccgttttctttcgcccattcaaattcttccttcattccggagcggatgccgaatgaaaatacgttttgcggcccgatgagctcggccgctttgcggatcggagtagagtgggaaagcggttcgccttcataatccgtgcgcaggtcggtgtgcgcgtcaaaatgaatgatggcaagatccggaaacttcttatacatggcttttatgacaggccatgatacaaggtgctcccctcccatgccgagcgggaacttgcctttttctaagatgccgtccacgtattcttcaatcatatcaaggcttctttgcggattgccgaacggaagcggaatgtctccggcgtcaaagaaattcaaatcagccaagtcacggtcgaggtacgggctgtattcttcaagaccgatagacacctcgcggattctccccgggccgaaccgtgaacccggacggtagctgaccgtccaatccatcggcatgccgtagaggatggcgtccgcctctttccagtcggggcggcttgcgataaatacttttcctgaataagcttcatcaaatctcatcaataataccctcgctttcctgtaaaaaagcgcaagattcgctcctgcgccgtacgtttttatttgattaagtcgctcacaaatttcggaagaacaaatgccgctttgtgaagctctttcgtgtaatatttcgtgtcgatgtcaaagaaacggctgtcctccacttcaagcggatcgtactttttagaaccgatcgtaaatgtccacaggccgctcgggtacgtcgggatattagccgtatacagacgggtgatcgggaagatttctttcacgtcacgctgtacgtttgtaatcagttccggtgtaaaccacgggttgtccgtctgcgcgacgaagatgccgtcttcttttaacgccttggaaattccggcatagaagccttttgagaacagattgacggccggtccgaccggttctgttgaatcaaccataataacgtcatactcattttctgatttcgcgatgtgcatgaaaccgtcatcgactctcacgtcgacgcgcggatcatcaagcttgcccgcaatggacggaaggaattttttagagtattcaataaccttgccgtcaatgtcgacaagcgttgctttttttacgcttgggtgcttcagaatctctctgatgacaccgccgtctccgccgccgacaacgagaacgttttccggattcgggtgcgtaaataacgggacgtgcgcaaccatttcatgatagacgaattcgtctttttcagaagtcatgaccattccgtctaagaacagcatgttgccgaattcttctgtctccaccatttccagatgctgaaattccgtctgttccgtatgtaatgtttgtttcacctttaatgtaatgccgaaattcttcgtctgcttctccgtataccaaagctcgctcaattgtcatctccctttcaaggcttatttcatttattgtaagcgtctgtatcgcttttattccggttaaaatctcattttcacctaaggaaaaagtatagaggatggaggggaaaaagtaaagaagtgtccggtttgatatgtttaaaaaacccccttttttcacataataatagaatcatgaaaaagggggttcccaaaagtggataaagtatctggaaaacagctcagaatcacgttcaaaatcatccgcgcctgcatctttctgacactgatcggcggaatgctggccggcgtctgcttcacatccgttcttcttgcagcgaaatggcagggcgccccctccgtccgggttcctcagtctacgattctttatgcaaatgacggctcaaagctaggtgagaccgatttcggggaaaagcgctactgggtccggttaaaagatatcaatccgacagcggtgcaggccgcgattgcggtggaggatcaaaacttttacaatcaccacggttttgattaccggcggatggccgccgccgcgctggctgacataaaggcaatggccaaggttcagggcgccagcaccatcacccagcaatacgcgagaaatctctaccttgagcatgataaaacatggaaacgaaaatggaacgaagcattttacacgatccgccttgaacagaactattctaaaaacgagattttagaaggttatgtaaatacgatatattacggccacggcgcatacggaattgaagccgcctcccgcctgtatttcggcaaacacgccaaagatctgaacgatgcggaagccgtgcttttggccggcataccgaaaggcccgtccggctattcgccatatgtcagcgaaaagaaggccaaacagcgccaggaaaccattctccgtctgatggccggacaaaaaatgatctcaaaagaaaaggcggaaaggcttaagaaaacgccgcttgcctatcagccgctgaaaaacagaaccgcagcgaaaacggcgccttatttttacgatgatgcgatgaaagaactcgagaaaaagctcggcatgacgcgcgaacagctcgcaacgagcgggttgcgtgtttatacaacgcttgataagcgcatgcagcggatcgcggaaaacactgtggcacatacgatccgtaccggctctgacattcaggtcggcttttccgcgattgatccggcaacagggcgcgtgcttgcgcttctcggcggacgtgactacgaaaaaagcccgtttgaccgggcgacacaggcgaaacggcagccggcttccacgatcaagccgcttttgtactacaaagcgattcaaagcggctttacaccggtcacgctgatgaaaagcgaagccacagagttccagattgacgacaacggagatacctattctccaagcaattacaacggctactacgccaataaaccgattacgctgcttcaggcgcttgcgttatcagacaacatttatgccgtgaagacccatctctttctcggcatgaataagctcgtgtcggcggcaaaggaattcggcatcagcgaacatttaaagccccttccgtctctggcgctcggaactgaacccgtgcgcccgattgagatggttaatgcctacgcgatgctcgcaaacgggggaaaacaaatcaccccttcctttatcacaaaagtgacggataccgccggcaacgtcttgtatgaacagccgcgcggacatcagcagacgcttgataaaaaagccgcttttgtgacggcgagcatgatgacgggcatgtttgatcaggatttaaacggctatacttccgtcacgggacgcaccatttctgaccggctgacccgaacctatggcggtaaatcaggcacgaccagcgcagacagctggatgatcggctttaatcccgctcttgccgccggtgtgtggacaggctatgacaaaagcagcacgattgattcagtagaagaaaaaagctatgcgaagacgatttgggcggactttatggagaaggcgctcgaaggagaaccggaaatagcgcttaaaccgccgaagggcgtcacgggcgtctatatcgatcccgcttccggctacacttccggacccggatgcgccgcaaagcattatacgtatttcatcgcaggcacagagcccgcggatgtgtgctacggaccggaaccgtctaaaaaagaaaaggaacacgtccccgcccgtaaagaagctccgcgcaaaaagtggtgggataagtggctcggcaaaaaagactgagcccggtgcattgcgcgccgggctttactccgcgtcttcctcaagcacccatgggagcaagagtgaaaagtcgagatggataatagggtcaggaaaacccttcggtataaaaaatgttgtactcgccaatgaaaacgaaaagcggatatctcccgccctctcgatatgaaactttggccagccttccctaagcctgccgacaatcggatagctgcccgcataatgatgcaggccgttttcctttccatgctcccccaaatcgtgacagacagccggacgaatcccaaactgcgtaaacaatcttgttttctcggcggaaaggagattcaccgcctcggaaaagttccggcagcacccgcaatcgcagggatcaggccatgatttttcatattgttttctcgtttccgccgtatctgcttcaatgacccaaggcccgatttcaaagacggtgaacatgatgaaacctccgcgtaaacatgaaaaaccccgagtcttggttcggctcgggactttccatgtcctgattctgtatcaacagtttactcagtacaattgcgaaatagtgcaaatatttataaagttcacaaaaagttcacaaattatttttcgcccggaagcagacccgttttcaattcatcggatgaacgttcccagagcccttggtcatgcttctgcagaaattcagcaagcacctgctttgagctggcgtccattttgtccacgataatgcggcgcttcattgatttatccattaaattcacatgctccggcaatgacttatagcctctgcggatacttctgtccacggtcatttcacaagccgtcacacccgcgtaataagggccttcttcttttctgtcgatggtgacccacacgagccagtacggttttccgttcggcacttcatctttgttcggcaggaatttgatgcctttttcaacgacactgcgggcatgcattgcgccgatgtcaacgaaggcttccttctcttccacatcgacaaataccggagaaatattatcaaggctcagcgacccggcgccgaaaccgccatgtccgtcggtcggatcacttttaataatattaaatccgattgttttcttctttttttcttccatgaaaataccctcctacaaaagcggttgaaatataatggcaaataccttaagaatccagtctctcccctcgcttaacagcggccacacgacataggagccgaccggtgtcacaaacagcacgagaaacacgataatcccgtagctctcaaactgagtcattttggcgcgcacccgcggcggcacgaaatcctcaataatccggtagccgtcaagcggaggaagcggcagcaggttgaataaacacagcgcgagattcagctgaatccaaatagagaaaaagcggtcaagccccatgctgaatgcagaaagcagctccattccgtaagcatgcatcaacactagcaaaaagaaaccgataaaggcaagaagcaggttgcttacgggcccggcgacggaaaccagcactcccgccagccgcggtcttttaaaggcgcggcggttcaccggcaccggacgggcccagccgaaacccgcgaccaaaattagaatcgttccgaaaacatcaagatgtttaatcggattgagcgttaatctgccctgtctcgccgcggtatcgtctccgaaccgatacgcgacatacgcgtgcgccagttcatgcatcgtaaatgccacgatcagcgtaatcacgacatagggcataagctccagcggataatataaaaatctgtccaaatgtcaaaatcccctttttttaaaaatgcaagattgtccttcattcagtatactataagtgatctctcttccaaagagaggaaacgataaaggaggatcagcaccatgccgctcgtaaccgttaaaatgcttgaaggccgcacagatgaacaaaaacggaatctggttgaaaaagtgaccgaagccgtaaaagaaacgacaggcgcagccgaagaaaagatcattgtcatgattgaagaaatgagaaaggatcattacgccgtcgccggcaaacggatcagcgatacggagtaatccttgataatggccggcgctgctatgtcaggccggcttatttcacaaccttttcaaccaggctgaaaaagattttcttttcttcctctgtcaatgcttcgaacagttcgtcaatcagcagctgccggttttcaatcatttgcatggccgccatttttcccgattcggaaagcgtcatccataccgtgcggcggtcttcgttgtttctcgacctttccacgaatccttctttttctaaatgattgagagcggttgtcgtggcggaaggcgataatgtgacctcctgcaatatatctttaatcgtgcacgtgccgtgccggtaaataatcctcagaataaatcctctgatattgtttatactcttcggaattgtcgcctcatcaagctttttcgtgctctttaaatatttcgtgagcgcgtaatccagtacatttgcttgcaagttatcgtgcttcatgcagaaactccccatttcaagatgcatccatcatcatttgtttgttttttattacattttactgataccttacggagaaagtcaaaattccggccggaatgcccgcaacttttatcctgccctgcacagacttttgtctccctcttttttaccatatccttttatgcaatgctggttttatagacacgattcaggtaaaatcattaagggtgactgcgtttgacggaaaggataatctgatcggatgcggcagacaatatgattggaaaagaaaagaaacggaacagacggggaaacagaacacaggattgtcgattacacagaagatgtgacacgggtaaaagccaaagagtccctcttggcttttgcttttggatggagggatgcgtgttgcggaatatcctacaaaaaaaagacatcacccagctgcttgaacaaagcagaaacaggcagactgccaaaacgatgggtggatttgatttaacattactgggcatcggcgccgtcatcgggacgggcgtcatggtccttacaggcattacggccgcgaaaaacgccgggccttccgtaatcttttcttttatcattgcagccgttgtctgcagccttgcagcattatgttacgccgaaatcgcttctgttctcccggtttacggaagcgcctatatttactcttataccaccatgggagaaattgtcggccatttaatgggctggacgctcttatccgtttatatggtgacggcgtcggcggtggcaagcggctggtcaagttattttaataatctgttagccgaaatcggcacgcctttgccggacagtctgctgcacgtgccgagccaggggggcatcgtcaaccttcctgccatcatcattactctattaattgccgtcgttctgtcacgcggctctaaagagagcaaaacctttaataatataatggttctcgtaaaaatcggaattgttttgctgtttatcatcacaggaagcttttttgtaaagccgggcaattggcatccttttatgccttttggaatcaaaggcgtcattacgggggcttctgccgtcttttttgcgtttctcgggtttgacgcgatttcggcttcggctgaagaagtcaaaaaaccgcagcgcaacctgccgatcggtattatcggttcactggtgatctgtacattggtatacgtcatcgtctgtctcgtcatgacgggtatggttccgtattcacagcttaatgtgccggaagccatgtcttatgtgctgcagactgtcggacaaaacgcggtggcgggcattatcgctgccggtgcggtgatcggactgatggccgtcgttctcgcccatacctatgcggcgacccgtatatcttttgcgatggcaagagacggaatgctgccgaaagtctttaccattgtcggaaagaaatcgggagcgccgatctttaatacgtggctgatcggactgatcagcgcatgcatcgcgggttttgttgatctgaaagagctgtcagatctctcaaacatcggcgcgctattgacatttgccatggtcagtctgtccgtgctgattctgcgccgcacccataaagatcttccacggggatttaaagtgccgtttgtacccgtactgccgattttggccattatctgctgtttgtttttaatggtcaatctgccgctgaaaacgtggctttattttgccgtctggctgatcatcggcgtcatcgtttactttttatattcgtacaagcacagcaaattgagacaataaacaaaaccaggcccgcttcattgcggcctggttttttcataaaaaaagacgaaagccatcgcctttaacaaatgtgtttcagctcttctatgtagtgaagcgcctcatcatattcttcatccgtatatttctgtttgctttttatcgtaaacactttctctttcttttcctcagcttcaaggccgtcaaaatacaaaatcgtagacaccagctccagaaaccgggatgagcggctgttgacgctgtcgatatacttcttcatatccggcatcgtaagctccgcatgatgtaaaaactcggctcccgtctccgtcagcgagtaccggtattgaaagtagccgccctttttttccttcacctcatccagaaacccaagattgcacagctcttcaattcgaagcgtcagttcttcggaatacgggccgtaaaaatgaaaatcatatttttcgtagaaaggatactgcattttcttcgcgatataaatgattttctgcagctttttccgcccgatgatttctccagaatccgagaacaccttcatcagttttgcatgttctttcaacaaattcccgacatctccttttccttctttaccaaaatccttttatgtcagtcccagcagctgccggatttttaattttgcttcagggttttctgaatcatcaaaaatgaggtccatcggatagtacagcttatgatccgtccggcgtttgcccgaaatggattcgacaatagcggactgcctggacagctctttgatctggccgttctgcgttaacagatgaatcggcagacgctcctcctcttcacccggccggtaaaaatcatacggcagatccgatgaagaatcgaccactaaatagtaattgggatcaattcccgcctctttaaacagagcggtcagttcaaaataagccgacatttcctcattggggttaaattcggcgtattgaaacagctggcggttaatgaagcggcggcacaagtcggacagaatcgggtcctcttcttcctcccaagcctggaaataatataaaatgatggcttcatcaagcttcagataatccgcaagcgtcagcttcccttcaaaaatggaataaaaatgaacgggagcatgagtgaatatatacccttcttcatggagctgcttcgcacggtggagaattttcgtcaaaatgacttctgcgcttctcgtcacgggatgaaaatacacctgccagtacatttgatagcggctcataatatagtcttcgacggcgtgcatgccgctttgcttaatgacgatctggtcctctcgcggacgcatgacccttaaaatccgttccatatcaaaatgtccgtagctgacgcccgtatagtatgcgtcccgctgaaggtaatccatcctgtcggcatcaatctggctcgaaatcaggctgaccacctgtttgtttttgtatgttttggcaatgacttcagcaacatcctgcggaaatcccggtcccgcctttctgagaacctgattcacctcggtgtcgccgagaatgatttccctcgtatagtcttcatgatccagatgaaaaaccttttcaaaggaatgcgaaaacggcccatgtcccaaatcgtgcaaaagcgcggcgctgagacagagttcgcgttcattgtcatcccattcaggacgccctttaaaaacatcatcaaccattcgtctgacaatctcatagacgccgagagaatggttaaaacggctgtgttccgcgccgtgaaaggtcaaatacgtcgtaccgagctgtttgatccggcgcagccgctgaaattcacgggtgccgatcaaatcccagatcagcttgtcccgcacatgaacatagcggtgaacgggatctttaaacactttttcttctgataattttccgtttggatacgccatcgtcattccctcttttttttagccgtgattctattatatcggctctgtaatttgaaaacatccttgaatttgtccggcgttttgttccagttttccgacattgattttttgaagcaaaaaagcctgacccatcgggcgaggctgtcgtaaaaatgcacatttactttttgatcttctttttcactttctcaatcagctcgtcctcagtcggcgccgacagcgggcggttgtttacgaaagcaaacgattttttgcgtccgggcccgcaatatgactgacatccgacctccacttttgcatccgggtcagcttctttcaaacgcggcagcaatgtcttaatattggtggcctggcaatcatcacacactcggaattcattagccatgatgtacgcttcccttcattcagtgttcctctatgttaaatcttaattttaaaaaacgaaaaaaatcacatcacgttttattgtacaaggattcatcttatcctgcaaggctctgcgtatctctcattctttcagccaatttgtataaatattttccaatctggacattctaataccatcaaagattattgggggttgagaacattgacaaagcaaagacaggacgcctggtcggaggaaaatgacctgctgcttgcggaaaccgtgctccggcacgtccgggaagggagcacgcagctgaacgcctttgaagaggtaggcgataaattaaacagaacgtcggcagcgtgcggattcagatggaatgccgtcgtgcgccatcaatatgaaaaagcgcttcagcttgcaaaaaaacagcggaaacagcggatgcgcgcgctcggaaacggccagccggccaagaagaaactattataccagccgcctgcaccggatgcggacatcatgcaggaaaccgcatccgaagagacggttcaaacggaagcgccaaaagaggatcggcaagccgtcatgtccggcgaacatatgccttatgtcgatgaaagcttcaaggaagagttagctagtttatcacatttgctggcgcctcagcagccgagccaaaaggcggagctcacaatggcagacgtcattcaatttctgcagagctatgaaggcagcggaaagcaaacttccgccctgcagatggaaaatgaccgtttaaaacgggaaaaccaagaacttcagtctaaaaccgagcaactggaagcagccgtcgaaaagcttgaaaaagatcaaaaaaccattcaggatgactacgaaaccttggtgaaaattatgaacagagccagaaaactagttttatttgaagacgacgagcatgcctctccgtcctttaaaatggaccggaacggcaatttagaaaaaatggccgaataacgcaaaaaacccctttccttgtcatggaaaaaggggtttttgccatttgtcaatgacgcgcatcctgatctatattaatgtaaacattgttcaggaggccttcttcccgcaagggctgcgcatctcggtccccgcccgcacataagcataaagattcaattcctcatcccaaatggttcttgggaattattgatcgatcagctactgtgcaatacactgtatagagaatacaattattagatatgatgggaatgatagtaaatgagtagccaattacgaaaaggagcattggaactttgtgtgttgtccctgcttctttatgaagatttatatggttatgaattaatcaaggtcataagtgaaacgttccctgtatcggagggcaccatctaccccatattacgaagacttacgaaaaataactatttaaaaacgtatacagcagcttcagatcaaggcccgtcacgcaaatattacaaagtaacagaagaaggcgccttttatcatcacacattaaaatcggaatggcttgacctgtccgaaaaagtgaacagcatcattaaggagggaaaatgaatgtgtaaagaccaatatttaaaacatctccggcgggaaataaaagatctgccggaacttgagcaaaaagagatactcgccgatatcggcgaaatattccaaatgggcggcgctgaaggaaaaagcgatgaacaaatcgccggcaatttaggaaaccccaaaacacttgcgcgcgccttaaaagcggatattttcatcagtgatgccgaggagcagaaaacatggcgctcctttttcaaagcattcggcctgatgctgggtatgggcatgttcaacttcatgtttatgctgacaccgtttctttttgcctctgttgcggtgttaagtttgatggcaatcggcctgatgctgatgaccggatcattctttctcctcgtaaaagtgccgattgtaacagccatttttaacggatgtatggtcctcggagcgggtatggcggtgtttatggccggatttgatctttcgaaactgatattccgcatctttttgcgctatttcaaatggaatgtcagcattgtaaggagggaaaccattgaatcgaaaaatgtggtatagcattgctctcattttaatcgctgccggcctgatcggaagcatgttcttcggttttgacggcttttaccctaaatcataaggaaggtgtgcacgtagcatgagtgaaccagccctgatattaaaagatgtctctaaaactatcaatcatacccctattgtacagtcaatttctttcaatgtgagaaaaggtgagatattcggccttttagggcctaacggctcaggtaaaaccactattttcagaatgatcgtacagcttattaaaaaaacagaaggagccatttcattcagaggcagaccggacagcgactttgaatattttatgagacatatcggggttatcattgaaggcccggatatgtatccgaacatgaccgctttgcaaaacctaaaatattttactaaactgcgcagcacctcgctgcgaacggatgaccttatgaatacccttgcaaaagtcggactggagcaggctgcccgcaaaaaagtgaaacatttctcattaggcatgaaacagcgcttggggctcgcttattctcttcttcacaatcccggattattaattctggatgaaccgatgaacggcctcgatcctaaagggatgaaagaattgcgcaccattctttccgatttagcgaagcaaggggtttccattttattatcaagccatttattgtcggaaatggaggagatttgcgacagggttgcctacattaaaaagggacggattttaggaattgaagacatgaagagcagaaatgaccttggtcagaaaaagctgtttaccgtcacggtcgatcatccggcaagggcgaaagaaatattagagcaggacggtattcttcaagtacagcaaaaagacagccgcatcattgaattggaagcggaggaagataccatcccgtatatcattaaaactttggcagagaaagagattctgatttcccgcgtttctgcaaggactttgtcattggaagagaaatacatgatgattacagatcaggaggacgcggtatgagcatatttcatctggcgcagaacgaattcataaaaataacccgaaaaaaaggcacacttttatctctttttttcctgtttctcatcgttttgctggccggccttattatgaatcatgagttagatgcctcctcggataacaattggaaagaacggcttctcgccgaaaaaaaacaggaagaaattaataaaccggctgaaacggcaggcgtttattattctgctgatgttaagaataaagactattatttggagcataacatcaacccttatgaatggaacggctggaggtttttcggcaccgttacttcaaacgggcttgagattttcgtaagcttaaccgcgattttaaccgtcagcggggttgtttctaaagagtttgcccttgggacgattaagtttatcgctacaagcccgaaccgaagatggcggattttaacatcgaaatttctggcctctcttctgtttaccggcatggtttacttattttactgtgtgagctgtttgctgatcggcggcgtgttattcggtttttccaatgcttcatatccgctcgtctttactcatttaaatgacagtctgtataccatcagttcaatcaaagcatccggaatcattctgcttttgcgtttcatatcaattataagtattgtcaccattgcgttcactttgtcagtattgtgcaaaaaccaggcgctctccctttgcttatccattttactgctgtttgccggcagtatattgggcggaactgatttgcttgcccaatttacgtggtataaatttacgctctttccgcatttaaatctcgttgcttatgtaaataaaagtgcgggtgatgcgatttcaacgttaaacatcccctattccgtgacagttatagcgatctactttcttatttgtttattgatttctttttccgtctttcaaaagagagacattacagcatagacagagaggcggcggcataatgagcggacggcaggaaatactgacggtccagcaatttgccgctgaccgccccttggtccatcgctaatggattcaaataaccgaagctcccgctgcttcgctgctgaaagcgtagaaattcccgcccttcccgtataaaaagcgcctcatcgaatcggagaaatttcataatggctgtgtattttgcaacggcgtcaatgtgatactttctgcactcggctaacattaaacctgaaaaagcaaaatctgatgttttgtaccattttgtgagaaaaggctgtaattctttcatttgcaaataagagacggcatacagggcatccgcctgttctttctggatgccgcccggtgccatgagcaaatcggcctcacgtttcattgcggtttctaagaaaacgatcagttcttccggggtcaccgccccaaaataagctgctaacaccatgaggatcatagaggaaggctctgatttcagttcctcttgtaaaccgcggaccatttgttcaagtccgttatgaaaaaagatgctttttgcggcatccatcctgcggtacacatgatacgcatacgcgaacaggaccggatggcattcgtgcgttttttcccaaaaataacggtctaagaatagaataatttcttctgtatcctttcttttttcaaaatgatgacatgccgctaaaccgcaaaacaggtgcatgagatcatctgcttccatttcttccggctgcagctgaatgttcttccaaaaacccagcagccattcttctgttttttttatattaaaatgttccttgactatccgcatgttccacactccagattcagaatctcaatcgccggcagaagagccggagcacaatgaatggatggattctcgttatttatatgatgaagagccgcttgacagccataaaaaaatggatcgatacacgattggataaataacatatcgcacagctgtttcatttttcggctgccgagacaaaacacaagccatttttgaatggaggccttcaagccgggatgaagcagatgctctccctggtctaaatgaagaagacagtactcgacaaactccagctcgttttcagctgttcttttccatgcgtcatggagcaaaggctgaaacatcgaattcttgtaaaagcgcactttttcatggtcagttgacattcccagctcattcagtaaaccgacgaattcggcatatttaaaataaggccattctttttttataagatagccgttttgcaatccgtgacgtatgatctgatcatccgcttccattccctgcttctttttataagcttttgccgttaaatagatatgaatcaactcattgacaatggccgtgttacagtgaaacagatcttcccagcatgacttatcaacgaaagcggaggcaatcctttcagtatgttcttttacaatagaagaatggctcgtctttctgtagtatttgcagaagccggcaaacagctgaatgctcttttgatccggaagcgattgttcagcaaaagataataaaaattgatccgtctcttcagctaatctgttcaagttaatcgttcctttctgttctaagacaggcatgcgcggcacccgcggcgacaagtgttgtatgatagcaatgtttgaacacatcttctcttcgctgttcacctttcaaaccgggtttatgttgataggtgatgctcgggacattcccctctttcattcggccccgatagattttattccaggctgcttcatagagcggtttatggttgtccttatccatgtcgatatgtaaaaaagagctgcacatcaataattcactggtaatatctaaattctcaagacagatatagatcccgagaaatttcaggaccttttcttttaaggacggcagatgatattctttatccgtaagcgaagaacatcccatgtctgttatataaaaaatcgtatgagtgatgctgtacgcatcatgatccgtcatatatgtatttgggatatcctggccagctgctgtgtagtgatataagtcagaaaagtccgttatttccgaggttacgcccgctctttgcagactgtacttcaaatccatttttcgaaagggaattttagcaaggctgcaatcaaaacgcgctgccgtgaatttttccagctcccatatcactgaagcctgtgacggatgatcagtcaaggtaagaaattcacccgcaatagccaatccggcgagaccgtccggatcaaaatgaataaattcttcaagctgatcattacggagcctttctgtaataaactccgttaaaacagcaacctccttatcatctgcctgatttctgatcaggtaattggtaagaaaaatgagttctataaatgttttaagacgccatctgaaatcattcgctactttatgattcatatcaaaataatggatattttcaacaatccatgacagtgctccccgcttaatttctcttatatactcttgtgtcacactctcaccgcctcgtctcagatgcgtaggctccaaacagtgattatcttacttttgagcggctaaatcagagaaattcaaattcgggttttgattgtcttcttggctcggcactacaagcacccagccgctccaagcgaaagaattgcctgattgttccgcatctccggctaacaaatgtgtcgggatcgtgattcttttttcttcttttatttttttaaagttcatatctccatctccttcagtttatagaattatttggaacctacataaatatattaatcaaataaggtatataatgtaaactagttttgatataacgattctttttcactataactaaatagtatataattaccaaaaacaaaaaaagcccggactcagtccaagctttcctgcgtgccgaacaccttctcattccgttccagcattcgggtcagatttttttcaaataccatttcctcttccggcgataatctggctgcatacaggcgtccgctgagttccttcagttcagtcaaaagcgccagcattaagtcctgcacggtaatgtccgtttgcagcaattcgcttaatgaagccatcgtttcgggccggatatcgggatatacgccttttgtatcgttgcttttgtcttttaaagcggcttgatagaaacgtctgatcagatcggcgcgttcgcttccgcttttatcggcgcagaggtaaatctgaaccgcggttccgccccgcaggcgtctttgtgagattcccgcgaattttcggccgccgatgctgagatcatagctgcccggacagtacgatcctttaatttcatatgcttcaatttcggcattgtgcggacgcagcatccgccgcaccagctctgtcatcgcctcgtagcctctgtcaatgtcgatgccttttttctcatcttcaaaaataagcgagatattcaatacgccttcatcgagaacgaccgctaggcctcctgaattgcggacaatgacacggtagccttcgtcctccagcaatttcacgccgtcctctaaaaacggcaggcgtgtgtcctgaataccgagcacgatcgtccggtggtgcacccaagagcgtgccgtcgcaggcgattcccctttgcctacggaggcgcacagcgtatcatccattgcgaatgactgcttcgcatcaaaataagggccgaggctggattggtcaatgattctccagctcggctgcatcagtaaatcaatcggttgctttcccatctatattaaatccctttcgtcataggctttccatgcgtttattatatcactccgcttgagatgattgaaattggcttttcaaaagagcgatgaagatttctttgttttttgtgttctccataatggaagattggatgatagacagtttccgttttaaggagaatccttttatctcaagcacggaaatgctgccgtgaagcagatccttttgcagcacgctttttgacagaacggaaagacccattccgctgatcacggcttccttgacgccctggttgctgctgatcgtcatcatggatttcggccgcagtccgtttgattgaaggacatggtctaaatattccctcgttcccgaacccttctcccttgtcacccacgcttgattttgcaattcggcagccgggatgttttttctgccggcgagcgggtgtccgttcggtgcggcaatgcacaattcatcctccataaacggctgaatgtcgagctcgtttttccccgtatgcccttcaattaatccgatatcggcttgaagcatccgaaccgcttcgctgacctcctccgtgtttccgatcatgacgtccaggttcagttcgggatactcgttatgaagctttgcgagaagcggcggcagaatatattcgccgatggtaaagctcgcggcgattttgagcttccctttgacataatgatggtgggcgtaaatttcggatttcgcctgttcgtacaaaaagaccatctgcttggcgcgctgatagagaatgtcccccgtcggcgtcgtcgtaaaatgcttcggagagcggttcagcaaagcggtttgaaattctttctccaggtttttaatatgaaggctgacgctcggctgagaaatcatcagcttctgcgccgcctttgtaaagtttttttcttccacgacggcaatgaatgttttcagttccccataatacaaaaagcatcgcccctaatcattatttttcctaatcgtttagatcatataaatatattttactaatgattaagaccgcagtaaagtggagttatcaagataatgggaagtgactgagatgaagatgataaagggtatttcagttaccgcaggaattgcgtttgcggcttcctatgtcagccgcctgccgtttttgcatatgctcggaatgcttgtccttgccatgctgatcggcatgctctggcgcgccgtattcggacagcgggaggcattagagccggggatcgcgttctcaagcaaatacttgctgaaagcaggcatcatcctgcttggcatgagactgaatctggcggatatctatcatgcgggctggcacgtatttgcaattgccgtctgctgtatgatgtttgcgggtgccgttgtatacggactgtcccggctgttccgtatagatcagacactcagcacgctgacagcctgcggcacagcgatctgcggggcggctgccattgccgcgatcgcgccgcagatcagatcaaatgaaaatgcagccgccatcagcgcggccgccgtttcgttattaggaaccgtttttactgttgtatattctcttgcttatcatggattgggcttctctcctgcggcttacggagccttttgcggggcaacgcttcacgaagtggcgcatgcggcggctgccggcagcgccggaggaaaagcagccgtcgagatggcggtgatcgtcaaactgacccgggtcgcgctgctcgtcccggccgcattcatgctcggaatgcgggcgcgccgcagcggaaagtcaaagacggcttctgccgcttcgctccccatcccttggtttatcttcggatttctcggaatgagcgccatccatacatcaggcgttatttcagcttcgttttccgcatttcttgttcaagtgtcttatgttttaatcggcatggcgatggcgggtctcggtttgaaagtccatatatcggcgtttcgtcatagcggctggcgggcgctcgcagcaggcttgatcggttctctctctttgtccctgttcggctgggccgcagtgacgttctttctataaaaaaagccggtcctcgtaaaggccgggcttttgcggattacagcgcttgagcagccgtaattaacgcaagattgtagacgtcttccgcattacatcctctggaaagatcgtttacaggcatattcaatccttgcagaatcggtccgaccgcttcaaagccgcctaagcgctgagcgattttgtagccgatgtttcccgcttcaaggcttgggaatacaaatacattcgcgtctcctttaatgtcggagtccggcgcttttttctccgcgacagacggcacaaatgcagcgtcgaattggaattcgccgtcaagcgtaagctcaggcgctttttccttcgcaattttcacggcttcagccactttgtccgtctcgtctgatttcgccgatccttttgtagagaaactgagcatggcaacgcgcgggtcaatgtcaaacatttgagccgtattggcgctttcaatggcgatttcggcaaggtcctggctgtcaggagcaatgttgatcgcacaatcagcgaacacatactgctcgtcaccgcgggccatgatgaagacgcctgatgtttttttcacgccttcttttgttttaatgatttgcagtgcagggcgcaccgtatcggctgtagaatgtgcagctccgctgacaagtccgtctgcgagacctttgtacacaagcatcgtgccgaaatagttttcgtccagcaaagctttgcgggcctgttcttccgtcgctttgcctttgcggcgttctacgaaagcctgaacgagttcttccatgccttcatatgtatgcgggtcaaaaatgtccacgccgtcaagcgtaagatttaattctttcgcttttgcttgaatgtcttctttattgccgaccacgatcggctttaataccttgttgcccgccaagttgttgaccgcaaccaggatacgttcgtccaacccttcaggaaatacgattttcacatcttttcctgcgactttttcttgtacttttgtaaataaatctgccacgatattccctcctctatgttgacaaaaaacgcttacttttacagcatactcttcttccagctaaattcaaataaccaacttctattatagcgctttcaaaaagaaatcttatttttctaactaatttaattgacggtttgtttcacggcttagtttctgacacaaggcttcggattattcaaggtttctccacagccgaaacggttaaactgtgatatagtgaaggcatcaatgtaatgaaaagatataggagtgaagatacatgagtgagcagcaaaaaacgaacgaagccgcccaaacgcttgacggctggtacgcgcttcacgatttccgcacaatggactggacgtcatggaagatgttatccagcgatgagcgcctgtcgattattcacgaatttacgggactgcttgaaaaatggggtgtcgccgaaaaagaaggaaaaggctcgcaaacgatctacagcatcgtcggacagaaagctgatttcatgctgatgattcttcgcccgacaatggaagagctgaacgaaatcgagcttgaatttaacaaatcaaagcttgctgaatttacaatcccggcttattcttacgtgtccgtggttgagctgagcaactacctcgcaagcggagaaggcgatccgtatgaaaatccgcatgtccgcgcccgcctgtatcctgagctgcccgaagcgaaatacgtctgcttctatccgatggataaaagaagaagcggcaatgacaactggtacatgctttctatggatgaacgcagaaacctgatgagaagccacggcttgatcggacggagctatgccggcaaagtcaaacagattatcacgggatctgtcggttttgacgattacgaatggggcgtcacgctcttcagcgatgatgtgcttcagttcaaaaagcttgtttatgaaatgcgctttgatgaagtcagcgcgcgctacggcgaattcggttcattttttgtcggaaaccgcttgtctctcgacacgcttccgaagtttttgcatgtgtaacacccacccgcctgtccggcgggttttttatttgtcagaatttaaataaaatttgctatttttatcatttttttttacgatgtaaaggagattccattttggtaaaggggtgcagacagttgtcaaaacgaaccgcatttattatgggagccagtcaggggatcggcagagcgatcgctctgaaactggctgacaatggctttcataccgtcattaattcacgagttcccgaaaatatcgaatcggtaaaagaagagatcctcgccaaacatccggatgcgggcgtcaccgttctggccggcgatatgtcggaccagaaggcgagagccggcatttttgaagaaatcagatcacaatgcggacggcttgatgtattgatcaacaacattccgggcggctcgccggatacctttgaaaactgcgatatagaggatatgacaaatacctttacgaataaaacgatcgcctatatcgactctatgaaaacggccgcagcgatcatgaaacagcacgaattcggcagaatcattaatatcgtcggaaacctatggaaagaacccggcgccaatatgtttaccaacagcatgatgaacgccgctttaattaatgccagcaaaaacatcgccattcagcttgcgccttttcacattactgtcaactgtctgaatcccggatttatcgccacagaccgttatcaccaattcgtgaagaatgtcatgaagcaaaacggcatttctaaagcggaagcggaggaacggattgcctcaggcgtcccgatgaagcgtgtcggaactgcggaagaaaccgcggcgctggctgcctttcttgcctctgaagaagcctcctatattaccggacagcaagtgtcagccgacggcggcagcatgaaaagcatataataaaaacatcccgctctcagcgggatgtttcttgtaatgaaggaaaggacaaacctagcttttgaatccgcagcacgaattcccttaaatcgccctgttttgccaccattgatattctgacataacgctttccgccgctgccgaaaatctcgccgggcgtcacgacaacatgggcatgctccagcagatagtccgaaaactggtgtgatgactcgaattcattcggaatttcagcccagacataaaaagtccctttcggtttttcaatgctccagcctaattccttttcacataacgccgtgaaaaaatcaatccgttctttataagtgcgcttcagacgctccgtatgctcaggatttcctgacagcgccgccgctgccgcctgctgaaggccgccgaacatgccgacgaagacgtgatcctgaaactcattgaccgcctgaataattttctcattccccacggcaaatgccattctccagcctgccatattgaaggttttcgaaaatgaataaagctccgcgccgactgtttttgcttccttcgcctgaagaaagctggccgggttctgatcaaattcgaacgcgccgtatgcaaaatcgtgaataagatggatgtcatgactttttgcaaacgcagccgctttttcataaaacgcctgatccgcagtcgcgcccgtcgggttattcgggtaattcaaaaacatcagcttcgcttttttcaggacggcgggatcaatccgctcaaaatccggcagatagccgttttccggatgaagcggcatctcatgcagctccgctctggccattgtgattcccgataaatactcagggtagccggggttcgggactaaggcgatatcgccggggttcagcaggcattgcgtcaaaacgtacaaaccagctttccctccgccgaacagcgcgatttctgtctccggattgaccgataccccgtactctctctcataaaattccgcgatggcttctttcagaaacggatagcctctgaacgggccgtatccgtgatacgaaggattcagcgcagcctcccgcaatgtttcaacgatatgcggcggagtggggagatcgggattcccctgcccgagattaatgatctgggctcctgttttctccatctcttttaccttttgaaaaacgagcgaaaattcctgtttcggaagtgtcttgatgacgtcggacggtatgatttccatctgaaaggctccttataaatgaatttgctctgattcgttattccgttctgaaaaggatttattgaccagttttgtatgcagaaacagcccgctgaccaaaaggacgataaacgccatgatgactgccgcgtctacaatgttgatcaacatggaaccgacggcgatgcacaatccgatggacgcctccgccaccgaaaagatccggccctgaatctggttcgccgcgttctcctgaactttgaccttcgccagcacctcaccgtattccattgcgataaagaaaagaatggcggcaatgactgacacggcgaaaatcggggtaaacaaaaacagcgcaagcgagacgatcgataacactgtaaaatacatcagccctttattgttgttaaagccccatttgctgacaagagcggcgccgataaagccgccgaagccgatacagaacgtcaggatgaaattgccgatttccccgtcgcctaaaaagcggctgacaatcgggaaatagctgtagacgacaccccataaaagcgccatcgtaatcatcgtgaacatggcgtttaacacaaaagcatttgttttgatttccttcaggccttctttaaacgactgaaaagcttctcttacgttttctgactgaatcggcacgtattgaagcttaatgcggctgatgaacaacgcggagacaagataggtcaccccgttaaacgcgacggcaagctccacagaaccgcctaacagaaaaagtccgccggctgcagcgccgacaataatcgaaatcgtcgtggcttttgcaaacaaagtgttgatatttttaatatccgcttctaaagacgacatgaccgcgagacgtgccgggttaaagaacacgccgcttccgtaagaaataaacagcagcgccagaaaaagcagcggatattcgcctttcgggagaaatgtcagccccaaaaagatgacacctctgatcacatccgtccacagcatgattttcaccctgtcgagcctgtccacgagcacgcctaaaaacggctgaaacaccatcggaatgctgcggaccgcgataacgccggacgtcacccagtagtcatgatagtatgtagacaaaatgagcagggccgggagaacgcaatagtctcccataaacgaaagcgcctgcccgaaaagcaaatacttagagttcggtttcagctgtttcataccggtaacgcatactttgcagtcagcttcgcctgctgctgaatttgtttgattgattcggccacgtcacccgaattgcttcctttcagctcgaacgccgcaatgctgttgaacgcttcgaacagccgcagatccacggacgtacccgcctcggccgccgagaaagaaacgatttcggtatctccctttaagacgccgtcgggaatgtcaatgctttcaatgacgaaatcgacagccgtctcaggcagctggccgttctctttgaaatgctgaggatacaagtggcagtcggcgacatagcacggctcctgctccaataatcctttcggcagatcggcttcttttccgaaacagagaacatccaataacagctgcgccatatcgacgccgaagacctttttaatattcggaatcatgttccatcccgcaaatcgtgccgctgattcaatcaatccggcttcccggtttttcattaattttatttctgtatgtgtcgcgcagttttcgaggccgagtccttcattcgcctttttggcagcttcgacgattttccgcttcgcgtcatcatccaggatggacggcgtaatatgcgatgtctccgtgaatccgatttgcggtgttttatcatgaatcgcgacagggaagtattccccgtcggccatgatgccttctatactgatatagtcggaataaccgcttgtttcgtaccagtcgtcatactcgccctgcaaaaattcttccgcgataaaaggcgcttcaaacgtgaccgctttcggtacgttaatcgacttcaggtattcattgactctgttaaattctgcttctgccgtttccctctctttgatgagcgtcacgccgatggagctcgccagatatgtaggcttcagaataagcggcgttccgatttcctgaagcgcggcgcggaaatcttccagcgtcgtcacccgtttgtttttgatagacttgacgccggcccggttgaaggcggctctcattttgtttttatctctggcattttcagccgcctgtacgcccgctccccgcaggccgagacgttcacacgcttttgccatcggagcgataaacagttcattgttggtcgtaatggcgtcaaccgcgaacatgtcagccaccttgacgatttcttcgacgacttcttcctcaggtttgtcatgatcttcatgagcccagtaaatcgaatcgggatgctcaaaatcagccagactcttaaaatagtctttatctttaatgaccgcaatcgagtatttttcaattaatgccgcatgagaggctgtaattgcaaaaggtctcggaataaagctgacgaggttgtatttttcggctgcgcttttgtaaaacatatgcggcgggcatcccccaaggtcagcgataaccaatactgtttttctctccatatgtaaacactccttctctattgtgcggtgtatccaccgtctgcggtgatcgcgcttccggtcatatagcttgataaatccgaagcgagaaacagcatgacgttcgctatttcttcaggcttgccgagtctcagcagcggattgactttcgctttttcttttttgatttcttcaagcgtgccttcgttgttttcaaggaacgacttttcattcaaaggtgtgtcaatgattcccgggcacacgcaattgacgcggatgttgtgtttggcgtaatcgacggccatcgaacgcgtcagctgcagtacgccgcctttagaggcgttatacgcgggaatgtcgggccatgcgacgactcctccgacggagcacgtgttaatgatattgcccttgccgcttttgagcatatacttgagcgcgtgcttgctcataagaaacatgcccgtcaaattgacgttgagcactttgtcccaatcgctcagctccatctcatgaatcggggcgacaatctcgatgccggcgttattgattaacacatccaatccgccgaacttgtcaaccgctgaccggatggcgttttgacatgccggttcatctgtaatatccgtccggacaaaatgcagcctgtcattgttttctttccggatcatcgcttctccctgcgcttcatcaatatctgcgacgaccacattcgcctcttgattcagaaacgcctgaaccgcggcataaccgatgcctgatgcgccccctgtgatgaggacggttttatccgtcaggttcatgactctttcgcctctaattttttcgcttttgctctgttatagcgcggagggaaaaagatattgactgattttgaatctttttcaaatctgttgatggcgccgtgatcttctctcggatcgcagaaataagctgtgccgaatgtcatatccactttgcagccttcaatggtcatatcatagccgccgccgatgcagatgccgatctgttcattgcggtgtttatggaacggcatttctcctccgttgcccggaatgttggcaagcataatttccacccagtcttccacgaagaatgtgacttccatcccaggcaataagtctcttgttttaaaaatattcaaaaaataatcctcagggcttgtataggtttcaccggctttcaggcgtttaatatcaatggcgatcacttcttgatccgtctcgtttcttgcgccgtgaggcacgttaggaggcgcgatataggctgattccagcgctgtcatctttcttgtgacatctccgacagtcatggacagctcgccggaaacgacaaggccgatttggacttccttatgctgatgcggttccacgtttgtatgcggcggaacgtaagaaagcagaacttccgtatcgcctctgacggacgaatattgtcttactccgttatcccattctattaatttaggcgtcgggaaataaagttcctgcaaatcttgttcagttttcatcatgaatctctccttttccgaataatgaccagctcatgggaatgcttttaaatgttttgacaaagtgaaggccgtacttttgtctggccagctcatttgtcagcgcgatgtcggacaaaccgtccttcactcttttcgcggctgcgctcgttgagttcaccagatcaaacgtgacatctttacgggtaaaatacttaatcaaattgataggagacgggtgggatacgatgacagtcttatcaagcatgtcatctgtatattcaaaaccgggccggacagccaggccgtacatcggggtgtcgcacctgaaaatttgcagaagctgcagatccggtctcatgtagaagtgcttaatgccgtcatacgcgtgaggcacaattgtgtattccagcggactttgaagcgttttttcaatgcacgattcaaatgtatcatgcagtgataatttgctgttcaccccttggagaagggtgaaattggtgatgaagttttttgctgcgtactcactgcttgtcccttcaggaccgagcgtgttgatcgtaatcagtttagatattgaataagccttgctttttgtttgaatgctattatccaatataatcatgagcaccaaccaatctgttaaattttaagtaaatattatccatagacgttcaagctgtcaatattatttgaaaatattgataattattcctatatattagaaaacaccttatgatataaggtgttaaaaattaacatttacaaaattatagaaactttattttaccgatacaatgattggtcggtcttatgctcatatttcccgtaccttctgtatgcgaaaacgctgaggacaaagccgatgagggtgacggccgcacagataaatccgacagctgcatatccgtatccgccatagaccggacccatgacagcagaacccaaggtgacggccaaattggatgccagactgtaaaatgccatgattttgccccggcggctctgtgagcaatcacttaaaatagtgctgagcaaggtcaccgtcaggctttgcatcaacccccagacgaataacccgatgaccaaaaacggcattgatgacggcgcataggcgagacaggaaagccatatgctgatcacggccaatgccgcgatcaaagagcgcattttccccgccttatctgcgatttttccggtgaacacgctcatggaaaaaccgattccgtacaccatgatcagcagccctgaagctgtattccccccggcagcacgcggtgaagatatgtgccgagaaaggaatacatgccgtaaaaaccgatcatgttgcaaaaagtgatcgtgaggtatacagggacacggggcaccttcagcgcatcccggaaagtgcctgcctgccgtccgttttcctcttctgttttatccccatccgccgtgctgcggcgcgcctcaatgaaaatgagcgaagcaacgaggacagacatgagggcgaaaatccaaaacgtccaccgccaattcaaaacgccgccgataaaagagccgatcggaacaccgaaaatcaaagcgagcgaccagcttgacacgatcagacccatcaccttgccgcggtacgcataaggcacacggtcgccgaccaccgcatatgctgtcggcacaaacgcacccgccgcaagcccggaaagcgccctgcccagaaagaagaaaaagagattgtgcgccagcgcgcaaatcaccgtgccggccgtaaatataagcagtcccgccagcagactgagttcccgggaatatttatctcccagcggaacgagaagcggcgccccgataaaaatcatcactccgtaaatactgatggaaagcgccagcacactgacatccgaactgaaagcctgcgctaaatccggaagcagcggagaaatcaccagctcttcagaacccgcggcaaatacgcctaatgtcaaagcaagcgcgagacagaccggaaatcggcgtttcgtttcgatgtgatcggtttgtttgctgttcatgctctttgaacacctcttccgtaaaacttttctaccttttgttgttttatagtttagcatccttatatttcattttacatttcacatgaaaactaattctgattttttatttacattcagattttaaataaaatatttagtttgtattcaataaatgatataaaatacgccgtctggttatgctatagtgatagaatcatttgttaaggtgggggtcatgaaatgaataacgctgattcaaaggccgcccgcgcaggcctcggcatggtactgattctcgggacgctcgcttcattcgggccgctttcgctcgatatgtatctgcccgctttgcctgaagtggcggccgatcttcatacgacagcgtcacttgcgcagctgagcctgacgttttgtcttttggggctggcggtcgggcagatcgttgtcgggccgctcagtgatatgatcgggcgccggaagccgctgattctgtcattgctgctttatacgctgtcttctttattatgcgccttcagcccttctgtttcgtttttaattgtcatgaggtttattcaaggattcaccggggcggccggaatcgtcatcgcacgggcttccgcacgcgatatgtattccggaaaagaattgacggcttttttctcattactgatgctcgtcaatggggcggcgccgattttagcgccgattacagggggatttatccttcagttcgccggctggaaaatcgtatttatcgtgctggcggtaatcggctgtatcatttctgccgccgtgcttacggcgttgcctgaatcactcccgccggaaaagcggacaagcggcggactccgggagacgctgatgacgtttcgcggcctgcttggcgaccggatgtttatgggatttgcgctcagccaggcatttgtgatgaccggcatgttcgcatatattgccgggtcgccgtttgtactgcaaaacatctacggcgtatcggcccaaatgttcagcctgctgttcgccgtaaacggtgcgggaatcatatgcgccacccaaatcaccggacggatggccaaaacacatgatgaacggaagctgtttgtctccggtctgatgattgccgtcatcgggagcatcgatttgcttttatcacttgcgtttggtttaggcctggcggcagtctgcatttctttattcatcattgtttcttctgtcgggatcgtcacgacgacgggattttctttggctatgcagaaacaggagaaaggcgcgggaagcgctgcggctcttctcggactcctgccctttatcggcggtgcggctgccgctccccttgtcggtattgccggagaagaaaatgcctggccgatggccgtcagcattttcggttttcagttctgtgccgttctatcctatgttctgtcggccaaacgaaacacaaagtaaagcccgccgctttaagcgaagggctttttttcttatccggcagcgcctttttccgaagaagtcggctcacgcttcaggcgttttttgataccgaagtgataatacgcgtaacagatgatcatcagcgggacaccgcagtacagaccgatacgctggtcggggataaagatgagactgattaagataagaccgtaaaccgaaaatccgagaatcggcacgatcggataaagaggcgttttaaatgccaggtccttcagatttcctccttcagcgagaaagcgtctccggaaaacgaattgtgaagcgcagattgacatccacgcgacgacggtaatcataccggagatggaaatgagccacacatacaccgtttcagccgcgactacacttgtcagcagggataaaccggagatggcgatggtgatgaaaagagctttcagaggcacgccttttttcgtcagtttcgttaaggaagcggggcccatcttagtttttgacagggaccacatcattctggacgaagcgtacagcccggaattcgccaccgacagcatggcggtcagaatgacaaagttcatgatatcggccgcataaggaacgccgattttatccagcacagccacaaacgggctttcgatgacgcctgccgtttgatacggcaaaatggacacgagaacaaacatcgccagcacgaagaaaaacagcgtccgccatatgacgtttcggatcgagcggggaagcgtcttttccggattttcgctttctcccgaggcgattccgaccagttcggtaccctggaatgaaaaattcaccataacaagggtaaacagcacggcttgggcgccgttcggaaaaagccctttgtccgtcgtaaagtttgacagatacggagccgtctgcccgccgttaaaaccgacaaagccgaataccgcagcgcagccgagaataataaacaatacaatggccatgaccttaatgctggaaaaccaaaattccatttccgcaaaactccgtgcagacagcgcgttaatggaaaaaatgacgacgccgaataccaggcaccacacccaaatcggaacggccggaaaccatcgctgcattaaaatccccgccgacgtcagctcaagccccactgtattggcccagctgaatgcgtacatccatccgatcgtaaatcccgtcgacggcccgagaaactttgcggcatacgcctgaaatgatcctgcgaccggcatagcgaccgcaagctcccccaaacaaagcatcaccagatacattaaaaatccgccgatcacataagccaatatcgcgccgatcggtcccgcttcactgatcgtaaaaccggagcccagaaaaagccccgtcccgatcacgccgccgagggcgatcataaacaaatgccggcccttcatcgtgcgctgcaattcattttgattggtatctccctgcatatacatcccccttattccgttatgtcagccatttgtgcgtatgtctaatcggcagctgtgcaaaaggtgcattgtcgtctgctgaatgagttccggcagcacatggaatgtgtacggtttgtacacgcgttccgtccatttatggccgtcctttccgtatacccctatattgaccgacggaatattcaattccctgatttctttaaaaggaatcgtcccgatgacatcccagcccggaaaattatcggtaaaggcggagacctcctcgtctgtttcatgcagcgataaaaagcttccgtccgctaaataagggaaaaactttttaaagacgaatgtttctccggttgatgccgctgttttatcgaccgcttcttgaatgacatgctgcaaaagccggtcccgtgtgctttcttccttcagataattgtgcggaagataaggcggcgcatagaaaataatgactttggctccctgctcaggatcgagtttttgcagttcttcgacggctttaaaacatctcatccgcagttcaagatgttcatatgttttaaatgcctgcccgatacactgtgcagggtctatcccgcggcttctcagccttttcaggtaatcttccagactgtacacttgaacgttccatgtgatgtcttttttcgggaggctcgttctctcgcagtattcgtcgtaataatcagataattttcgttctgtctctttgcaggcttcgtcagccacggcggtcagctgatccatgacttctttggcggttttctcgtaaataaaataattaaaatagacatagctgctgacggcggtctgcacgttatacgcttccttgttgtcacgctggtagaggcaggtcggcggaagcacaagctccccttcaatgttttccgacatatgaatattgttgtgaattcttctggtgatttctgacgcgatcaaattcggatcgatgccggacagcgtatctccgacatgcacctcccgcccgtaaatcgcaaagcaaggcaaaagcttccctgccgcacccgtgtatatgtaccttgtcgtgtcaccctcatacagcggcgtgataaaatcgttattaatcgctgctaaataacgaagctgcttttcttgtttcagccgttttaattcagaaatgctggttaaaatgccggaatgctggctttcttcatccgggtttgccatgaacagaatatggcccggcagctgatcgcgccgttcagaaaagtgaagcagattggcgagatgaacggcaataccgctctgcatatcaaccgaaccccttccgaacatccactcgcctgagcgggcgtcccgctgcacatcccgatcaaattcatagtttgagaaatattccgcgagacggtcggaatcaaaagcgatatcttttaaagggccgaaatcctcgatgccgaccgtatcaagatgagcgtgataaatgaccgtattcaggctttcgccgtttccctcaataaatgcgaaaatatttttgcggccgtaagggtcctcaggaatcgcctgctcccacacatgtgacggattctcctgaaagtagggaaagctcttgatcatatctttgatatagtcggctttttttccttctcccaatgtgccgttgatgctgtttaaggccactagtgatttcgtaatggcttctattttctcctccggaagcattttgctgagctgctgatacatattccatcctccttaccctcatatagagaaaatagcgcgactcttttttcatcgcgctatttccgaaagattaataggcttcagacgttgtttttgcctgcatatgaagaatcagatagtcaggtcctccggctttcgaatcggttcctgacatattgaagccgccgaacggctggtatccgacaatcgctcccgtacagccgcggttgaagtatagatttcccacgtgaaaatcttcgcgggcgcgttcaatgtgcgcgcgggttttcgataacagagcgcccgtcagtccgtaatcggtattattggcaatctcaagcatatggtcgaaatcacgggcttttgagatcgcgacgacaggcccgaaaatttcctcctgcatcaggcgggcgttttcatcaacatccgcaaaaatggtcggctgaataaagtatccttttgaatcatcaccttcgcctcccgtcaggagttttccttctgttttgccgatttcgatataactcatgactttattataagatgcttcgtggatgactggccccatgtatgtatcaaaatcttccggacttccgacggtgagtgattttgttaaagcgacggctttttcaacaacttcatcatagacgtcctgatgaatgaccgcacgcgaaccggctgaacatttttgtcctgagaatccgaaggcggaatacacgattgaggaagcggcaagatcaagatcagcatctctgtctacaagcaccgtatctttccctcccatttcggcaatgacccgtttcagccacttttggcccggctgtacttttgcggcgcgttcatagatgcggcatccgaccgcgcgggagcctgtaaacgacacaaatctcgtcttcggatgctcaaccagatagtcgccgatttctcctccgtcgcccggtatgaattggagcacgccgtccggcaggcccgcttctttcattacttcaacgaatttcgccgccacgacaggcgccgcatccgccggtttcagaagtatcgtgttgcctgttacgatggctgccgccgccgttcccgccatgatcgcaagcgggaagttgaatggagaaatgacgattcccaccccaagcggctcatagtgatactgattatattctccgtcacggctctttacaggagaaccgtctttcagtttcagcatctgacgggcgtaatactctaaaaagtcgatcgcttccgccgtatccgcatccgcttccttccacggttttcccgcttctttcactagatacgcggagaattcgtgctttcttctgcggatgatcgccgccgctttaaacagcacattcgcgcggtgttccggccgtacttttttccatgtttgaaatgcctgcagcgcagcctgcatggccttttccgcaagttcttttccggctgccgatacagaaccgatcacttcttttttatctgccggattgacggaaatgatctttttatccgtttcaatcgcttcaccgttgatgataagcggataatgcttgccgagctgtgaattcacataagccagcgcttcctgaaacgattgtttatttgtctcttcctgaaaatttgtaaatggttcgtgtgcgtatgaaactgtcattagaattcctccccgtattttgtaatgtgtgctcacgcttaatgaagatgcaagaagcataccagcatagcaatttgtgataaaaaaagataatctttgccgaaagctagtccgaatctgtcagctgcaatctgaaaacgcaaagaaattttgcgatccgctatataactgatgcaaaatctctttgcggataacacttatacccagccgcggaaccgggccgcttcagccgactttctgatgcccgtcatataggcggccaaacgcatatcgactttgtgggtatgcgctgtctgataaatggattcaaatgaattcaccatgacactgcgcagttttccggcgacttcttcctcagaccagtaaaagccttgattattttgcacccattcaaaataagacaccgtcacgcccccggcgcttgccaaaatatccggcacgagaagcacgcctctttcattcaggattttcgtggcgtctatcgttgtcgggccgttcgccgcctccacaatgattgaggctttaatgtgatgggcgttttcagccgttatctgattggagattgcggcaggcacgagaatatcacagtccttttccagcagctcccggttcgttatgacatcagagaagagattcgtcaccgtgccgaagctgtcccgcttatccagcaggtaatcaatgtcaaggccgtcagggtcatacaaagcaccgtgggcgtctgagataccgatcaccttggcgccggcgtcatgcataaatttagcgagaaagctccccgcatttccgaacccctgaatgatgatccgcgcattttccaatggaatcccttttttcttaacggcttcctcaatacaaatcgtgacgccttgcgcggtcgccgtttcccgcccctgtgaaccgccgagaacaatcggtttgcccgtaatgaatcccggtgaatcaaattctctcaggcggctgtattcgtccatcatccatgccataatctgagagttggtatatacgtcgggagccggaatatcctttgtcgggccgacgatctggctgatcgcgcgcacatatccgcggctcagccgttccagctctccgaatgacatcgtccgcggatcacagatgatgccgccttttccgcccccgtatggaagatttgtgatgccgcattttaaagtcatccagatggaaagcgccttaacctcttcttcactgacttccggatgaaaccgcacgcccccttttgtcgggccgactgcgtcattatgctgtgagcggtagcccgtgaaaacctgtactgaaccattgtccattttgacggggatgcgtacggtcaaaagccgcatcggctctttcatcagttcatacatattgtcaggatagcccagtttgcgcagggcttcttttatgatcgattgtgtggacaagaacaaattaagaacttctttttcttcatctttctgattgcttttagaaagcgggttggctgacatgttttatcacctcatcgtattttacgtgtaagcttcaattaccggcagaacgaaatgtaagcgcttttacaccaaaacccatcaatccctttcacattgtcgttacacccctttttatatgcaagattcatgccaggattttgcgcataaaaaaagaggctgttgtcagcctctttcatcccggattaacgcgggtcaataaccagctttgtttcggcatagagactgccggcccccaaaccgtttacgtaatcgcctttaattgtatacgtgcccgcgcgcggaaggtttttacgcaccaggacgagattgtattcagaggcgcccaataagtcaagggtaagcggaagtctgaccgtttttccgtagttgagaatttgcgtttctttcagtgttcttccgtttacagagtccctcacagtggcgttgaacccgtcaggaaattgaaattcaacggcaccgacggcaagcagcgcattcggcttgtatgtgacttcaatatcagacgtcgcgtattctttcgtactattgacggttttcgcttcaataacggcagattgggcgttcgcatgaaaagatggcaagaacacagctgaaaataccgcagcactgatgagaaaggcagaaaatgattttctttttaacatcatgaattcctccagatcatataggattcagagcgtcctctgccggaaaagcgtgtctgatgattccattcgcgaattgggtttctcttttcctgagaataatctaccacctttatccatggaagtaaattattttttagaatattcaatcatttatttttcgcgagatgaatcagcacaaaaaaacgaagacatccgctgtcttcgtcttgtgcgctaccggtgagcggtctgccagtcaaatccgatggtgtcatcattccacggaattcttttttcgtcaggctgatccggattgtaggacattgtcgtgaaataaataatggtcagcggggtttcgcccagcactctgtacccgtgtgcgacgcctttgggaatgagaaggagcatcggattgtcttctcccatgtagtagacatccgtttctcccttggttgccgactcttcgcgaaggtcatgcagcacgacctgggcgtggcctgtcgggaaaaaccacaggtcatcctgtttctcatgatagtgaaacgctttaatgacgccgggatagcttttggaccaggaagcctgcccgaaacgctctaagagatgttcatcgtcacggacgagttctgagaaaaaaccccggtcatcgctgtgtttgatcagctttttaatttttacgccttcgatcacttgcactgtccctccctttgtaaataatcctgcagcgcttcccgccaatgcctcatgccgagcccctgccgttcaatcgactcaaggctcaacaccgagtaagcggggcgcggcgtctcatttccgtattcctccgtcgtgacgggcagcacggcggcggttctgccgctttcttcaaaaatagccttggcaaattcataccagctgcacactccgctgtttgcggcgtggtacaagcccggcggcttgtcaaacagaccgatcaccgtttcggctaaatcctttgtgtacgtcggtgcgccgacttgatcgttaacgacacgaacctgatcatgtgtatccgcaagtttcagcatcgtattgacaaagttgtgcccgccgctgccgtacacccacgacgttctgataatggtgtggttttttcccgttaaccggatcagttcttcgccgagttttttgctttttccgtaaatcgtgcccggatctgcgggatcatcggtctggtatggccgtgttcctttgccgctgaagacgtaatcggtgctgatgtgaatgaatttcgcgccggtgttttcagcctcaagcgcggcataataagcgccgattccgtttattaaatacgctttgtcgagctccgtttcacatttgtcaacggaggtgtatgccgccgtattgacgacgatatccggcttgtaatggctgaacgagtgccgcaccgaacgctggtcggatatgttcatcatcgcttttgtcaaggcaatcacttcatacccttcccgcttcagctggcggcataactcccgccccagctgaccggccgctccggttactaataccttcgtcaatcggatccccttctttccgattagtcttggctgtctgtataccagcgaatggttcttctcattccttcttcaaatgtgacgtcctgccgccatcccagctcatttttcagctttgaagcattgatggcgtaacggcggtcatgcccttttctgtcttcgacatgagcaaaccgttcctcgacaccgagctccttcatgataaatgacgcaagctctttattcgtccgttcatttcctccgccgatattgtaaatttcgcctagtgttcctttttccagcacgagcttaatggcgcggcaatgatcttcggcaaacagccagtctctgatctgcatcccgtcgccgtacagcggaaccggcgtaccgtttacggcatgcctgataatggtcggaatcattttctcgtggtgctggtacggcccgtaattgttgctgcatctcgtaatgatggcaggaagcttatgggttttcacataagacatgacaagcaggtctgagcttgccttgctggcggaatacggattgttcggagaaagcggcgtcgtctctgtaaaagcgggatcatccggtgccaaatctccgtacacctcatctgtggaaatgtgaatcagcctgccggcttttccctgtaacactgcgtccgccagtcggtatgtgcccatcacatttgttgtgatgaacggctctgcctgatttatgcttctgtccacatgggattcagccgcaaaatgaatgacagcgtcatacatttgggaaaagactttgtcaatgtcctctttttcagaaatgtcacctttgataaaacggaaacggctgttcttttttaaggcttctatttcaagcggcctgcttgcatacgtgagattatccaggacggtaatctgcgcatctgtttctttcagcatcatctttgtgaaggtaaggccgataaatccggcgccccctgtaattaaatatgattttggcatgattaatgctcctgtcctttctgtaatgcctgatgcgccaggcttccggcgaggtagagcgattcatgcgtgcccgcatccacccaccagcccgttaacacatcatacgtcagctcactgtgttcaatgtataaattattgacatccgtaatttccagttcgccgcgttttgaaggagaaatttgttcaatataagaaaacacttctgcgtcgtacatgtagatccccgtgacgcatagtctggtcggcggctgcaccggcttttcaatgatcgacttgatccgtttgttttcctcatcaatctcggcgatgccgaagcgctccggatcgtcaacttctttcagcagcactttcgctccttttccctgctttgcgaaacgctccgtataaggttttaatgaatcttcaaaaatattatctcccaaaagcagaacgaacggatcgcgcccggtaaaccgctttgcgtatgataaaccgtcggaaatgccggatgcggctggctgaacctgatatgtgattgagacgccgagctcttctccggtttcgagaagtttatgaaattgcggaatatattctttttgcgtaatcagcaagatatccgtaatccccgcttcttccagcttcatgatcgaccagtaaatcatcggatatggaccgacagggagtaaatgcttattgaccgcttttgtcagcggcataaggcgtgagccggtgcctccggctaagataacacctttcacatgaacacttccttacgtgtggttttatcacaaatcataaagaatcgccgccgcccgtttaatgcccctgccgtcaaccagcggctttccgttctgatgaagcccgagccgtctcggataatcagcagccagctcagacatatgccgagcgagcacgtccgccgcggtgtgttctcccaggccgagatgaacggcggcgccccgtgcggcgaatttttcagccgtcacggtttgatgctccacttgagaaagtacaatgcagggcacacctgtacaaatggtctcatataaagtgatcccgccggacacgacggccatatcagcccccgtgagaagcgcggccatgtcatttgtctgcattaccatctcggcataaggcatttgtgtgatcagcgcgcgcacgtcatcagcatgtggcgcggcgccgcccatgacgatgatcactcgtttccgctgaatgccggggatgcggcggcatgcttccatcactttaaagacaagcttcttcgggtcgcttcctcctaatgagaccaatatggtccggcattctttattcagctgataaagctgttttgctttttcaaaacccggatgaagaatcatataatccgggccttcatataccgcggcgctgcctatttgaaccgtccggcttttcagcccgccgtaaatgccgtttataacggcatcgcataaatgaatgacatgttcccgtttttcttcaaataagacgatacgagccgatgaatgctttttaattttctccagccagtcacacggcatatcgagcagatcgaatatgagaaggtcgggagcccgcctgtttatttcccggacaataaattgcttctgtcccttgtcaggcttgatgatcacttcccattgatcagatgacagataagaagaagcctctttatttgtgtagaacgttattgagcaattgttcttaatggcaccggcaagcagcttcatccggaccgcgtgccccatgccgatgtcacggcccccgtccgcgaaaatcaaaacccgcatgctaatcagcctctttttgccggatcatttgattaatggccctgagctccggatcacgattcagcagatggatcaattcttttaccggaatatcaggacgcgagcccgcttttacgtacagctcgcgggccagcctgtagtcctcttctgtatcgacggtcatccgcaagtgaggagcccggagttcctgcgggggctcaggaaagagaagccggtacctctcaggagattctcttatcaaaagggtgacatgctcctgatatttgtccgccagcgttttgtccgcattgatctccgttaaaaggcgcgcgttcaccgcctcgccgccgatcccgagcggtgtaccgcagatatacgtgtagtctgcgtgctgatctaaatgcgattgaatcagaaaatcaagcagcgaagggtcgacaaacgggttatcccccgtcagtctgactgcgatgtccggttttacttgttcgatgacttgtgcaaaccggtcaagcacacgctgttcgctgccgcggtgcacacggtagcggttgctgaggcagtgcgcagacagaatgtcgtcggtcttgctgtcagacacggcgacgatcagattatcccgtgattgatcgtaaaacgcactttgccgaacccttttgacaatcatatcgaggatcgtatacccgccgatcggtttcagcactttgccgggaagacgcccgcttcccatccgcgcctgaatgataaacaaaatgtcagtcatcatatgggctgcctttcgtcaaaaggtcatcccaagtgatgcccgtgtcggcggggatatccctgaccgcacgcgcgccgtcagttaaaagctcaaaatatctcgggtgaagcccctgcggtttttggccgggacgaaggacggcaaggttttccgccgtaaaacattcgcctttttgaatcggcgctgttgaaaaaatgcctctgtaagcgaaccttctgatatccccttcaatcggtgtcgtcgttttatgggaacttcccgacagcacttccggcaccggagcgtgatgcccctgccgcagctccgcttcaactgagcggatcgccgcaaccatttcttttaattcatccggattgagggcgaaggagtgatcagcaccgggcaggtttttatcgatcgtaaaatgcttttcaatcagtttcgctccgagcctgacagccgcgcacggcacatcatacggatgggcgctgtgatcggagaaaccgatcactgcatccgggaatgcggcggcaagcatgggaatgacgctcagattgctgtattcaggcggcgcgggatatttcgccacacaatgcatgatcgcaatttctttgttcccctcgccggtaatggtttgataagcctcctgaatatctgaaatatcagcgcccgcggtggagaagataatcggtgtcttcagccccgcgacatatttcaataacggcagatggttcagctcgtaggaggcgattttaaaagctgaaggggaagtcgcatacagtaagtcggcagagccttcgtcacataccgtgcttaaaaacagcacgccttttttcttacaatattcaagcagcggttcgatccactcagcgggcatttccattgattgcaccaaagaaaaaatagagacgttttttcccgcagctgttttgtataagccggggtctttctgatacattttgtcagcctgaaacatttggaacttgaccgcgtccgcgccggcctcactggccgcatctatcaattcaaacgcctggctcagttttccgtcatgattaattccggcttcggcgatgatgaatacgggcgaaccttcgccgattgacttcgttccgattttgcatgatgccatcagtccgcctccttcccgggccacacatgatagtagtaataggacgcatccgctttaaatcccattctttcatacaggcggacggctcttacattgtggagctgcgttcccgctgatacagtcttatgctgaaaacgcaatgattgttcaatcacgtgcgccgctaaatggtatcccgctccttttccttcaaagcccggctttaccgccatcagatcaaggacgaattcatcgcctttagacagcccctgaacaaagcccgcggtctctcccttatatttggcgaggaattgtaacgaagctcttccttccgcgttattccgcgcccactcttcaaacaggcggtttgcactttcatagctgagatgggggtcttgataatacctgctttttgtaaaggcgtcgcgggccagccggctgatcgcttccgtgtcgccgggtccggcttctgtaatctcaaacggcggcgtgctgttatatacacgcaccggactgacgagcttgagaagactccctacaaaataagcgttcggaagctgctgcacgacctgcatcgcgccgatatcttcagccggtattttaataaatataaaatcagtgccgtccgcccgccttgccgcgtaaaattcctgaaacagccttttgagctgtccggtgctgtttgcggctgcaagcttcacattgatgatattttttcggaacaattgactttcccacgaagagttttcatataaaatcacgccttgaaggctgttttcttccaataaacagagcgacgattcataggcttccggatgaatgcccttctgatgcaggaaggcatgaatcatgtcctgcgcaagattttccctcagtctgtacacctaatcagcccctttgacgatatccgtaacggctgcaatgacgtattcaacgtcatcatctgtcattgacggataaagagggagtgatacggtgcggtgataatacgcggccgcggccggaaaatcagtttccttatatccgtacgttttttgataatacggatggaacggaaccggaataaaatgcacacttgtgccgatattatattggtctttcaaagcggaaatcagatcgttccggctgatcccggcctcctgctcctctatttgaagaacatacagatgccatgcatgccgcccgtcatcactgacatacgggacggtcagccctttcatgtctctgaaagcgtcctggtagcggcttgcaatgtcagcccttctttgctgcatgctgtcaatccgtttcagctgatgaagcccaagcgctgcctgaagatcaaacatattcattttatagccgggcgtttggacctcgtagtaccagcttccgtttgaagaatagcggttccacgcgcctttgctcatgccgtgaaggctgagcaccctgatctgatcggcaagcccgtcatcgtccgtcgtcagcatgccgccttcaccggttgccaggttttttgtcgcgtagaagctgaatgccgtcgcatcaccgattgatccgatcattttctgtttataagtggtatacacggcatgtgcggcatcctctaagacaaataactgatgcttttcggcaatggccaaaatctgatccatatcacacgactggccggcgaaatgaacgggtacaatcgcttttgtccgcggggtgacggccgcctcaattttttcagggtctgcattcagcgtaagcggatcgatgtcaacaaacaccggaacggcgcctgtgtgcacgattgtattggctgttgaactgaacgtcacggcagacgtgatgacctcgtcaccgagaccgatccctttcgctttcagggccaaaaacaaagcggcggtacatgagttcagcgcgatcgcgtgctttgcccccgtccaggcggcaaaggctttttcaaacgcctctactttcggtccctttgaaagccagcccgattcaagcgtatcaataacctcctgaatttcgtccttcccgatcatgggcaatgaatagggaagaaaagctgatcttttttgcaccatttttttgcgctcctatcttttttatgaagggtcaacccgtctgaagctgactccggttttttcctgaagcacttggcataaagcggcaagcgaatcctgtaccgggtagttcgcggcgacaaaagcacggcgcgcctgttccgctttttgatatgctgcggggctttcgcatatccggattaattcctgagcgagtgcctgcgggtcctcaaagacaaattctccaagtgaatgataataagggtatcggcgggttcccgctgattttccgatcagcacgggcttttgaaacagcatcgcttcaagaccgaccgttgatgtctgtgtcaccgcagcgtcaacatacgggagaatatcatacagctccatctcttttttgatgattttgcctgctttatatttccgcagcacctgattgtaagcatccagcttgtttttgccgatttcccacggatgcggtttaataatgagctgcatgttcttttggccggcaagctcttcaagcactcccgtataaaattcatcagaaaacggctgcgtggcgatcagcaccgtccgctgtgacgggagaaaagaaagtttgcggtaaaacgtgtcccgatctatcggctctcttgagaaaatctcgtcgaaacggggatgccccgtgatgatgatttgttcatccctgcagccttttgctttataccactccgcttcataagccccgaatacagcctgatagtccgtaaatacgggcagaaacgcttcatctcccatgagcgctccgtgctgcagacagatgctgacggcgttttttttcgcggacatcagcgccagcacacggctgtaaatatcctccgtcgtgccgactacaacggcggaaatcttctcggccgtaaacaaaatatcaacggcgtcaatcgcttcaataaataacgggatgtctttatacaaacgttcctgaaattctctgtttccgaaagcgggatggctgtgaagctctttcaaaatggaatgggctttttcaatataagggacggggttccctttttgtcccatttccgtcagctccaatttgcagataacgggcagcccatgatggtcaggcagactccatctggccagtaccgctgtttttgccggatcaaactgccggtaatttccctcggtgaaccgaagatgatcgaaatgcagaatgacttttccgtttaccggtttctcatctgttttcttaatgttttgccttttttgatcataataaggctgaataccggcttcaggaatatgctgatccgccggaccgaaaagctctgggttctgctccatgctctcccgaagcgccggactgatatattgataaaaattactgatcaatgcgagcgggatgtctttgtagcgaagtgactgaaaaaggtcaatatactgccggtaaagcacccaatagttcgctaagtatgccgacaagccctcacccctttccaagcttttttaatgattccctcagctcccggcacgtggtctgctgcggaaggctgttcacaaactcgtttttctccgccgcgaaaagctgataatggatggattgatcggtaatataattgatatcaagctcctcagaaatcgggtaaaacggataaaaatgattcactctccagaaaaaacgggcgtcaccgatacggtaaaacgcggggctttcatcccaataggaaccgaatgccgatttgacctgttccagcacggaaaaccggtgcatgaccgaacaatggtcaatggcgcacggcgcgttccacacgatccgttcggcgggcctggccgtctccttcaccgtctctttccgctgattcagatgataggttttggaacttgaatacacgacggctttttccgggtcttcatcaagctctttcaccattttctcaagccgttccggcacatacgtgttgtcgtcggtcgcatacgtcacgtactcgccctccgccatttctattgcctgattaatcaaggcggcgtagcgtgttttttccgttctttctttgacgcccgatacatcgctttgataaaaccggacgcggtcatccgtgagaaaaggacgtatttccgccaatgtctcttcatttgagttgtcatccataatgaacagttcaaagtctgtaaacgtctgagacagaatacttttaatagagcgggccacatagtcacttttgttatagctcgtcatgatcactgacactttaggcaactcgtcacccccttttcgcacctgaaactaccgctatcatatgttccttatgcggaagatgcgctaggaatacagactattatgtgaaaagtcagcattgcgcgcacaaaaaaaagccggctctgatgtccggaaacattggatcgtattttcttttttcgcataaatctttctttgggctcatatggtggaatagataaaaacagcagccgctctgtcggctgtctgatacttgtcaggaggtttcagcatcaagaggttttcatcaaaggaggaacaatatgaaaccgaaaaagaatcaatatcagcaaatgcaggggatggggatgggaatggatatgcaaggattccagccgcagctcgggcctaatccttatccgcagcctcagggccaaggatcacaaatgatgccgatgcagcagcaaatgacaatgccgatgcagcaaggccagcagggcttcggcggggggttccccggccagccgcagcagcagggcggcggcagctttcaaatcccgtcaggtccatcatcgtcacaaaacgttcccggcatgctgccgattgaagagtcatacattgaaaatattctgcggttgaaccggggcaaaacggcgacgatttatatgacatttgaaaacagcaaagaatggaattcaaagattttccgcggtgtgattgaggcggcgggacgtgaccatatcatcatcagcgatccgaaaacgggcacccgctatctgcttctgaccatttaccttgattacatcacgtttgatgaggaaatcgcttatacttatccgtactccatgtcttcttattctccgagataaatcaaaaagccaatcgctcacttgacagaggattggctttttttctttataaatatttgacggccgcgacgataatcataatccaagagatgataaacgccacgccgccgagcggtgtaatcgcgccgagaatggaaatctgcgtcacgctcaatacgtacaggcttcctgaaaacagaacgatgcccgcaaacatcagccagcccgcgacagaaacactgcctgcgccagaaagcttttcggccaaaaacgcgacagccagaagaccgagcgcgtgatacatatgatattgcacgcctgtgtgccacacctgcaaatatttatcggggattttcccttcaagcccatgcgcgccgaaagcgcccagcgccacggccaataaagcgttaatcgcaccaagaataataaacactttcatctatttttctcccgccttttcgttaaagtttccaattcaatcataacccaacatcggcaaaattcaacgtccgtcatccgatgacacgagattgtcggattttttctttttgataagctggattcggtcaatcgctatcgccagcagcgtcccgagcacaaggccgttgcttaagagcgaaatcaggatcggatgcatccctgataacgcgctctccggcacaaacattacgccgacccccgtgaggagcgccagaccgataatggagcggattcgtttttgctccgctttctcataagagtcaaactctgtaaaggcaagacccgccatcgtggagaaaacgacgaagtttaccgcaaagccgaccggtgagggcagactcgcaaacgcattcataaatagcgggatcatactgatgatcatgacaaatacacttcccaaaagaaacggctttttcgaaggaagcttcgtcgtctcaataaaaccggccgcccctgaaatcggcacaggcgcaatgccccctgacagcccgctcaaaaggtggctgatcgaagccgcaaaccctgccggacgctcacgccgtttcccaacggtgccgccgaattttttcaccgccgcttctacaacccggatgctcgcgagcatgttgacaatcaaaagcacggtaatgaagagtgacgtaatgatcaggccgctgtcaaacacgggttttccaaacggaaaaagaaccggcagctgaatcacgcgatccggtatttgaatcggtttggcagcgccgaagacggcgaataagatccatccgccggcaagcgaaaggagaatcgcatactgtcttaagaacgtaacattcgatcgggacatgatgaacatcgccgccgtcacaaccatggcgagcccgaatacaaggccgtcgacgctgttttttaaatagccgatgcccaaaaggcctttcacaatcggctgactcagctgcatgaccaacagcagcagatacacaccggtcacaaccggcgtaaacagcacggccagccgttcaatcactttaaaaaggctgaacaaaaagaaaaagacagcgcttaataacagcgccccctgcagcgcccgcagcgtctcgccgaatgtcgcaaacaccgtgcccgtcagtccgccgtaaatcgtgtatacgccccaccataagcctgccgggctttcattaatcggcagacgatgtccctggagacattggatgaccgcagcgacgccaagcacaaaaaatgtgctctgaatcaatgcggcagaatcggcatggttcaagtgaaatgattgtgcgatggcgacaggaactacaatcgcagccgcaatcataaatgccgtccattgcaaacccccgagtatcagtttcaagtcaatcaacctctcctgttaaaaatcgaaaatggaatccccgtttccgtcttcctcacgttcgtctttcgcttttttctgatattggttcagcccggcgctgcccatcattttttcaagcagcagcgggtctgtcgaaggagacgcggaaggtttcggcgccgctttcggaatcggattctgcacaggcgccagagcggtgtgcgtctgagtgccgagcacgacatcacacagagagcggatggcggccgcgtgcattttgacctcctcggtgcgggtcgccgttttcgcctgcctcagttcttcttccatcttctgaatcaaagcagagatatgtatgttcatgagtaaatcctccagcagtaatttgtcttcttcctgcattttatcaaatttctgagcggatcgcagaatggagtttgttattttttctgacggcataccgcccggaacgtcaaaaaagacgcttccgccgggcggaagcgtctcaaaaaaccgtttattgcggcaggtcggggatgcaccaatcgatcggctgctcccccattttttcaagggcggcgtttgtacgggaaaacggtctgctcccgaaaaaaccgttccttgccgaaaacgggctcggatgagtcgattcaataataatgtgtttcgatgtgtcaatgcgctcttttttcatctgcgcgtgacgcccccacaggataaagacaatcggcttctctctttcattcaccacatcaatgatgcggtcagtgagccgctcccaccccttgcctttgtgggaattggcctgaccgcggcgaaccgtaagcactgtgtttaacaaaagcactccctgcttcgcccagctgacgagcgatccgtggttcggtacggagcagccgatatcgtcctgaagctctatgaaaatatttttcaaagacggcggctgtctgaccccgggctgaacggaaaaactaagcccgtgcgcctgtcctgggccatgatacgggtcctgtccgagaatgaccgcttttacatcctcatagggcgtataatgcaaggcgttaaaaatatcatggctgtcaggataaatcgtttggctgctgtattcttgtttcagcatctctctcagctcttgataatacggtttgtcaaattcatctttcagctgattccaccagctgtcttttaaaagctgtttcaaactgtccgtcccccttatgaactgtgcagtcttgaatggacgggctttccgtcccacacaatgtcagtcggcgcctcccgcctcttcatgtccggctcttcaagaagaaccgcgaagtttttcgtcgggagctccccaagcccgtgcttttcgcttaaccggtctaagtaccgcttccgtttgccgccgagatccgcggactgattgccgcctccctcaaaaaacgcatatatgacgcttgcgcaaggaacacgcttcacacagtgctgtttcgcggcgcgcaaataaaagtcccaatcccaataattatggacatccggatcaaaataccctaacgtgtcatgcagagaacgtctgtacatgctgcctgacggaacgtacgtggaaaatacccgcatatccgcataatccgccgtataggcgaatggctttcgtgacaccgggtatctcgtgccgccccgttcttcaaatgacacaatttccgcgtcagaatggacaaaatccgcatcagcaagtgcagccgccattcttttcaaatggcccggcgtaatgaaatcatcatcatcgcacagcatgatgtaatcacccgacgcttttttcacacctgcgttccgcgcttccacatgtccggcattctgttctaaatcaataatctgaatcggcagatcgctgtacagctgcttcgcttgttcgaccgattccccggcatcatttacgatgatgacttcataaggcttaatggtctgcctggaaatcgactccagcagttcacacaaagccggaatccgattatacgtgactatgacaattgatatattcatgacccgctccttctgctttttctcatgttctattaaaacataaagcggcggagagatcaggggggatttttgatttcggcccattcagaaacaaatccaggtcatccccgccagcaaaaccagaatgatcagaaggtctccccaaacagtgcataccgccttggcattaagtctgcccgcatccatggcattccaaagttttgattgataaacaggcaccagcaccatcgcatagcatgtgcacaagcagacaaaagccggcgggacaagcgcacatccatcctcatgccaatcatgaatcagttccggtatactcaccccgctgtcaatgtacaagtataatatacccgccagcggaatgagcgagctgatctgcagctcgaaaagcttcaccttccactcacgcgcaaacgaaacggcccaaatccatcccagcgcataaaacaatagaagaagcaaaatactgaaaacaacaaaaatagcgtcttgcatcccattcagaaacataataaaaagactcacaacgggcaatgcaagaaccaagccgcagacggtaaatacggtaacggctatttgggcgcacgcgccgtacatccacgaacctaatctcatataaacacccctatatagattccctatgtatatagtgaaaaagatcaggcaagtctctgcctgcctgcgtaaaaacctattttgccgcaaaacggaaaacataccgtcacaacggcgcatactgccgcaaaactcggtgtgaccgccgaaggaaacagcccagccggaaccagattgaacaaaaagacaaacataaaacatagattcggcaccattgaagcccataccgtccgctcagcaagctttttgccgccagccccgaactctttgccagcttgatagccgatttggaaccaatacaatacataaccgatcataatcagccatactgacacggaaatccctttccacagcgcgtcaacagcgggatgaaccctccacgcgtgcatcatcgtaatcatcgcccccatcacaaaaagaccgcagttgcagaacagataaaagagcataaaaatccgcgcgggcaccgccgaagctttttgaaaagcagagataatctcagacggagtccccacttcccgcagaataagctccatcgcttcgctttcggttttgcctttttccagatgatcacaaatggcatgatgaatatggctttcgatttcctttaataattcacggcttccggccttgccttccagcccttttctgatttcccgcacataaaggtccttatccattctgcccgccccgcttcagcatccggtccatcagagcggagaacagattccattccttcgtccgttcggctagaatgttttttccttcatcggtgatccggtaatattttcggtcgggccctttggtctgcttttcccagtaagaagaaatatagctttggcgttcaagcttatgaagcgatgggtacagcgtgccttccttcatttgcagttcattcccgcttcttttctccatttctttcacaagttcatacccgtacatgggccgttcattcagcagcgtcagcaccagaatgaccgtgctgccctttacaagctccctgttgagcatttattttctcacccttacctagtaatcttatgtaggtattgtacgcacatcccccgcggctgtcaaatcattcctccaagccttccgtattgtgatcgggagaaaatctaactataatgagatataaaacactgatggaggccattgatatgtcaatgcacaaagcacttactattgccggttctgattccagcggcggcgcgggaatacaggccgatttaaaaacatttcaagaaaaaaacgtatacggaatgacggctttgaccgtgatcgtagcgatggacccggagaacagctgggatcatcaagtatttccgattgatgccgatacgattcgcgcacagctggcgacgattgttgacggaatcggcgtagacgccatgaaaacgggaatgctccctaccgtggagatcatagagcttgcggcgaaaacgattaaagaaaaacagctgaagaatgtcgttatcgatcctgtcatggtctgcaaaggagcgaacgaagtgctgtatccggagcatgccgaagcgcttcgcacccaattggcgccgctggcaaccgtcatcacgccaaacctgtttgaagcaagccagctgagcggtatggatgaattaaaaacggtggaagacatgaaagaagcggccaagaaaattcacgaactcggcgcgaaatatgtattgattacaggcggaggcaaattgaaacatgaaaaagcgatcgacgtgctgtatgacggagaaaccgctgaagtattagaaagcgaaatgattgatacgccttacacgcacggagccggatgcacattctccgccgcagtgacggcagaactggccaaaggcgctgaagtgaaggaagccatctatgcggcaaaagaatttatcactgcggcaatcaaagaatctttcccgctgaaccaatacatcggaccgactaaacattcggcgatgcgtcttagcggaaaataaaataaatatccccctcatgatcgagggggattatttcatttttttcgcggatgaccgcaaaaacatctcaatcgattgcacaaacagcgcatattccttcatctgttcatatgtatgcctcagccgatcactccattcattgtgcggctcagccctcttgagcatgcgattcagctgaagcaatacttctttatattcttcccgcttatcttccacttgctctgcggctttgacaagtaaacatttcggcgtcatcttctgatttttcaaagctgagaaaacaactccttttattcctggaatcataggctttcgtttgaagaatagcacagatggcataggtttcacataagaaaaaagaacgattttctacaaaagtgtccaaattgaggcatttatttccgtttttccaaccgaagtgacggttacgtcatcatttcccgggaaaggaaaatatctggcgctgaatacctcttctccatcattcaaaaacaattcgatggaggatgcatccagaaagagctggacggaatgcacctcgctgatggcgcagcttctcttttctttttcttctccgctgaaagcagtgcgctccagcacagccagcccctcttcctgatgaaatataaaccgggacgcaccccgaattgagatttcaaaaccggattcgcaagtgatgtcttccagcagcacttcagcccgggacgcatctttcaccgggaggcttacagacgagcaattcaattgaagactgcgcttttgttcatccatgcggcgcgatttcatttccgggagcggacgctgtatgattctgccgttggacagtgacagctgtctcggcatcgttaagcagtgaatccagtgatacgcatgtgtcggatgtttgtcctcatgctgatccggaacgcccatccacgcgaacagaatcctccgccccttatcatcttccagcgtctgcgccgcataaaaatcaaatcctctgtcaagctccgtaaattcaccatgcttaaattctggcggctctgtatgcagcctgccgaggaaatagcccgcctggtggctgttatgatattttatcccgtcggcttcaagcccctgcggacatacgagcagcacgtcggttccgtcaagggaaaacaggtcgggacattcccacatatagccgaatgacccgagaccgcccgagtccgcccccgcaatcgaaccgagaaacgtccaatccgtcaagttctctgacgtgaacaacacagcgcttccggtgagcttttctgtctgcgcgccgagcaccatgtaatacgccccgtccttctcccacaccttcggatcacggaaatgagcggtatagccttccgggagacgcgcgacgactccttttttatcaaatacgatcccgtcttcggatacggcgaggcattgatacgtttcccgatttccttctccgtcacggacattgcctgtgtacatcaggcagagccgcccgtctttttcgatggcgcttccggaataacagccgtttttgtcataccactcacccggcgcaagcgcgatttcttcctctttccactcaacgaaatccttcgtcgtcacatgcgcccaaaatttcgcgccgtgccccgtatgaaatggctgccattgaaaaaacaagtgatatgcgccgttccaatggatgacgccgttcggatcatttaaaagcccgaccggcggcataacatgatagttctggcggtatggatctgacgcggctgtttcttgccgcttctttttcgcttcctcagcctgcaggcgcagctcttgatccggtgtcctcatttgacggcctccttttctttagctcccataatgtaagcggcaataaacgccgaaacagaggcgatgcccattccgatcagatagtttataagatttcctaaaccgagcggagccgtgatggcaatcatcggaattccggtcagaccgtaagcattggctgcgacaccggtcaccacgacataggcccctcctagcgctccgccgatcattcccgcgataaacggcttacggtaccttaggttcacaccgaaaatgactggttcggttacgccgagaaaagcggaaaatgcggcaggcagggcgatttctttcattttcgcttttttcgtcaggaaaaatacagccagtcccgccgcgccctgagcgacattcgccatcgaccagataggaaggatatagtttctgcccaaatcagcgatgaggccggcctcaatcgcatgaaagctgtgatgcacaccggtaagcacaataagcggataaagaccgccgaaaagaagtccggcaacaaagcccgcatgatcatacacatatgtcagcgagacggtaatgcctgatccgatcgccctgccaagaggacctattgcgataaaggtgataaatcctgtgacaatcaccgtgacaaacggcgtgaccaataaatcgaatgcgtgaggcacaatttttctcgtgcccttttccactttgctcataatgtaaacggctaacagtacggggatgaccgtcccttggtagccgagcagcgcaatgtcgaagccgaagagctgcataaaatcaggcgatgcatccgcaagcccccacggattcaatagcgccggatggatcataatccccccgagcacggcaccgagataggcattgccgccaaattccttcgccgcactgaacccgatgaatacgggcaggaagataaacgccgcgcttgaaaacatgtctaaaagcttaaacagcgatgattgttcagacacccagtggaaagccttcatcatgccgagcagccccattaaaagtccgcttgccacgatagccggaatgatgggaacgaatatgttagacagtgttttcgcaaatcttgcggccggattcagcttttttttcgccgcgtcctgatgtgtctcacgatcctcccgccccaaatcggcttcttttgaaaaagcgtcatacactttattcacaaggccggtaccgaatataatctgatattgccccgagctgctgaaagccccttttactccttctgtctcttcaatatcggcctggctgaccttatgttcatcttgaatgacgagcctgagccgtgtggcgcaatgtgtcgcgctgatgatatttgatttccctccgatgtgtttgataagctgttttgccgtttcttgataattcatgatgtatccccctttctaaaatcaaaaaagacctaaaattcgccaacgaaaaaggtcagcatgatccctttttcatgtacgcaaattttaggtcttgcctgcattaccagtcacaatcccgccgattcagttttttaatgcgctttcattttatttcatgatagcgctttcgtcaatatgttttcaaaaaaaaagtctgtttctcgaaacagacgcgttattccgggtttttttgcagacgctggacatgcagcgtaatatagccggcctcggattccggcagttccaaatcatattcattttttaagaacgccgccagttcaagcgcacaccgataagcaaacggatactttttttggatgaaataaagcatctcctcgtccatggaatggagtgcttcatttgagtccaaccggctgaccgcataccgcaagtgcgtgacgaggcgctgataggaaatactgtcttcatccaccttctgttcgaaaaaggattcgatcttttcgatcatttctttgatcatggttgtatgcttcatcgccgaatacatgcttttggcatccgccttggcagtgtggatatgaagcgcgatataccccgcctcatcatcaggcaatgatataccgagggtttgtttcacgtgttcaaccgcccagcggccgatttcatattcttttttataaagcgccttaatttcatgaagcaatcggttatgcacctgaaggccgttttgaatcctttcgatcgcaaaggataaatggtccgccagcgcaatgtggatgtgatcgttcaaaggtgccgcaagctctccctccgcatggctgatgatatcttcagccgcctctatatgctcttcgggaagcgtttctaacacttgtttgaacttttcattttcgtcgtgcacgacaaatattttttcaattttatgtttttgaatcacatcattttttctcttttgaaaagcgattccgggacccattacgatcttttcccgtccgtcttcttttattaacgccgcattgttatttaatactttgtctattctcaagaggttcgctcccgttcatatgtttagtgggattgtaccctctttttcatatgatgtaaaggtgccggacccgcgcgctcccgtttcggcaattctttgcggacaggcatccatcgatttttatccagcctgccgcgggccgatttcgtttcatcggtcaaatccgccgatcggacacggctcacaaacgaaaaagccccagccgtccgcttcgctttcttatgataagccgcttggtttccgtacacggcggctaatggatatcttccgttacccggcgccatccagttcatcagaaagaccatccacacccgtaaagatactagcaaacgtttcattgcaaatcatccctccgcttctttttgacagacagcttgttcgcaggcctgtttttctctccgctttaacggaaaaggcggccgatccttctccgctaaaaactagcgggtctagcaaccctatgactctatgatagacgcggccgggcgaattgtttgtcacaatatgagtgaaaaaacaaactagttttcagaagttttgttgaaagctgatggaaatgacctgaaaaatggaaaagccgataaaaaaagttatacacaccttatcccttggttaagcacagcttaaacacagggtatatccacatatccacaaactagatctatattttgtataggaacactcgttcccaacaatatatatacacaattttattcagttatgcacaggattctgtgtataactccctccttattcacagatcaatttccataaatgagtcatatgtcacaaggattattttgaattttcaagaaatatatactagatttctaatttagataaagaaaaagggggaaacacgattgaaaaaaggaatcatccgttatctgcttccggcttttgtcttatcctttaccttatccacaagttcacaggctgcgccggcttcaaaaccgcaaactcctgatcttgagaaggctgaggtatttggtaacattgatatgaccaccggcaaacaaacgacagtcatcgtcgagctgaaggaaaagtcactggcggaagcaaaggaactcggcaaagcacagacaaaaagcaagctgaaaagcgaacgctcaaaggtgaaaaagaaagcgctcaaaaccattaaacacggaaaaatcaacagggaatatgagcaagtgttttccggcttctccatgaaactcccggcaaatgaaattccgaaactgctgagtgatcaggatgtcaaagcggtttatccgaacgtcacctatcataccgatcagctgaaagataaagacatcaccctatctaaggatgccgtgtctccgcagatggatgacagcgcgccttatataggggcaaatgacgcgtggaagctcggctatacggggaaaggcgtcaaggtggccattattgacaccggtgtcgaatataaacaccctgacttaaagaaaaatttcggacaatataaaggatacgattttgtggataacgattacgatcctgaagaaacgccgtccggtgatccgagaggcgcgtcgactgaccacggaactcatgtcgcgggcacggtagcggcaaacggaacgattaaaggcgtcgcaccggatgctacactccttgcctaccgtgtgctcggtccgggcggaagcggaacaacggagaacgtcatcgccggcatcgaacgcgccgtacaggacggagcggatgtcatgaacctttctctcggcaattctgtgaataacccagactgggcgacaagcacggcgcttgactgggcgatgtcagaaggcgtcacggccgttacatcaaacggaaacagcgggccgaacaattggaccgtcggctctccgggaacgtccagagaagccatctccgtcggagcgacacagctgccgctgaacgagtacgccgtctccttcggttcctattcctcagcgaaagtaatgggctacaacaaagaagatgacataaaagcactgaataaaaaagaaacagagctcatagaggcgggtatcggcgagcaaaaggattttgaaggcaaagatctgaaaggaaaagtcgcggtcgtcaaacggggcagcatcgcctttgtggataaagcagacaacgccaaaaaagcgggcgcgatcggtatggttgtgtataacaatgccccgggagaaattgaagccaacgtaccgggcatgtccgtaccgacggttaagctttcatcagaagacggcgaaaaactcgtcagccaattaaaagcgggcggcacaaaagcgacattccatttatccgtcgctaaatcgctcactgaacaaatggcagacttttcgtcacgcggcccggttatggacacgtggatgattaaacctgacgtctctgctcccggcgtaaacatcgtgagcaccattccgacccatgatccggccgacccgtacggctacggatcgaaacagggaacgagcatggcttctccgcatgtagccggcgcagctgccgtcatcaagcaggccaaaccgaaatggagcccggaacaaataaaagccgctctcatgaacacggcggaaaccttaacggacgcggacggtgacgtatacccgcataatgcgcaaggcgccggaagcatcagaatcatgaaggcgatcaaagcagactcccttgtcgccccgggaagttattcttacggaacgtttatgaaagacaaaggcaatgaaacgaaaaaagaaacctttacgattgaaaaccaatcgtccatcagaaaatcatatcagctcgagtattctttcaacggcacgggcattaccgtttcgggcacagaccgggtcgtgatccccgctcatcaaaccggaaaggtcaatgcgaaagtaaaggtcaatgccaaaaaagtaaaggcgggcacctatgagggaaccgtcacagtgcgtgaaggcggaaaaacagtcgcaaaagtgccgacgctgctgattgtaaaagagccggactatccgcgcgtgacgtcaatcgacgtacaggacggcacaacgcagggaacctaccaaattgaaacctatcttccggcgggagccgaagagcttgccttccttgtatatgacagtaatcttgactttgtcggccaagccggcatctacaaaaagcaggataaaggctatcaatatttcgactggaacggcaaagtcaatggtgacaccgcactgccggcaggagaatattatatgctggcctatgccgcgaacaaagggaaatcaagccaggtgctgactgaaaaaccttttatcattgaataaccgaacaaccctgctggagcatcagcagggtttctttctgactattcggcaaaagcttctcgaagcagacggtatgactgaagtttatcttcaaaatgatgagtaatggtcacagccattacttcttctgttccgtatgctttactgagagccacaatctgttccttcacttgctgcttcgttccgatgatcatccgattccgattatcggcaattcgtctttgttcatacggtgtatacgtattgccgcggacggtttcgtaagacggtacgccgtgaagcggaatcccctgttcacctgcaagcagcgtataatccatgacagccgcgagttcctccgctttctcctccgtatccgcgcacagtacaaacaccgccacggctgtttttggttcttttcctaatacagaaggtttaaatctgcgcttatattgtgctgtcgtgctttctccgccttctccattaataaaatgggcaaacatatagcctgctcccatttctgcgctcagaagcgcgctttcccccgaagaaccgagaagccagacttccggcgccgtcttaataaggggtgatgcggtcagattcggaaaacggtgattgtcatcagctgcatcatgcaaatacatcgccagctcacgaagctgctgcggatattgatcagcattacgcttccctccgtcattcagcgcccatgatgcgatcggcattccgcccggcgctctccctaatccgagatcgattctgcccggcgtcaacccttcgagcactcggaaattctccgccactttatatgcgctgtaatgcggaagcatcacaccgcctgatcctacccgaatgtccttcgttttcgccgcaatatggctgatcagcacttcagggcttgaacccgccaaccgctctgaaaaatgatgctctgacacccaaaacctcttatatccgagcttttccgcctcctgcgccagtcttactgtattccgcagtgcactttccgcagaacacccttctgatacaggagattgatccaatatacttaatgaaatcatcactgtcacctcatcaacatcgtaccactgctaagccgttttttctttctgtatgcttataagcatccctgatgataaacatttatataccttgttccattttgtcgaaatatgttacacgtgaaacataaaaaaacctctcccggtcaggagaggttttttcttaattcttttgaaaacctttatcttttacatattgatttaaataggttctcggtttttgtttcatgaactgcaggatttgatcagaccacgtttcaacccgcttgccgtttgtccgtttatcataataatcggaaatggtttcatcatattccttcatataactgcggaagttttcttcattcgtatcgtacgtgtcttcatgatatacggcttgtttcggcaggcgcggcttttgaccggacggatgagcgggatgaccgactaccaagccgaacagcggcagcacatggtcaggcgttccaagcacttccgtcacctgatcaagttcatttcgaatgcctccgatataacaaatgccgagtcccattgattccgcggcaacacttacgttttgtgcggcaagtgcggcatcaataacgctgaccataaacatttccgtattctcaagaagctcggtaatgttttcgcctttttcctcagcaagttttttatggcggtacaaatcagcgcaaaacacaaacaagtgcccgttattttcgacgtaaggctggtttccggccagtgccgccagcttccgctttttctccttatcggttacgccgatgatggagtaagcctgcacgtaactggacgttgacgccgcctgggcgcttttcactaatgtatctatctcttctgctgtcagaagctcgtcagtaaatgatcggatcgaccgatgattaagtatggtttcgatggtattgttcatatataaagcctccttctctatatatcatatccgaaagagtatcatgccaaaagcgaaatgctctaaacaaaaaaagacagcccgaaaaacgagccgtctcacattaagaattgaacaagtagcttttatatttcgtcagctgcacacttgcgttatatacgatcccgaagctgattaatgtagaaagcaccgagctccccccatagctgacaaacagcagcggaataccggtaaccggcataatgccgatattcatcccgatgttctggaaggtgtgaatcacgataagtgcagtaaaccctacgcaaaaaaacgcgccaaatcgattaaacgcatgcaagcggtcaatcagcaccacaagcctgtaaattaaaaagaaaaacatgacaaccacaatggcgcagcctaaaaacccaaaactttcacccaaaatcgcaaagataaagtcggtctgtccctcaggtacgtacaccttcagattatgaacgccgtttccggtaatgccgcccgatccgattgccataacagcctgatccacctgccagcttttatcgctctcggcctgagtcgttgccgcactggagtcagacatccacgatgtaatccggttaatttgataatccgcaatgccgattgaattcgccacatggggaaattcaattaccagcactaagaaaaggccaagcacaagcgcggccgaaccgccgataatggtgatcagcttccagtttacacctgacataaacaccatcaccataacgataaacagacagatcgcacccgttccggcatcctgcaaaacgatcatcccgatcggaataaccgtccatgccgcaattttcaaaagcagattcacatcttcccgaagtgatctttgatctttcgggcccgccttcgatataatggacgcgaccatcatcataattcctattttcgtaaactcagagggctggagggtaaagctgccgatttgaaaccagctcttcgctccgtttttgatcggcgcgatggattccggcgccacacgcaaaaggagcagcgacagcacgccggcaatcaatacatacagactcagtttctcaagctgctctaaatcaaaatacagcaataatccgatgaatcccgcacctataacatagaagacaatctgtttcatccaggcactgcctccgtactgcccgaactgtccggccgcataaatcgccgcaacactaattattaaaaacacaccaaatataaaaatcaaatccccctgataatagggattttgctgtttcttatatcgactcattctatcccgccttacattttcatcggaagtcactaatgtttattatacatgaacaccgttcaagaaaacatgatgaggttgcttcctttttattttttacggtttggggactacacgacatatgacgtgtcagaaaaggaaatgtttcggtcatgataaaacttttccgataaaaaaccccttctcgtcagaaaaggggtttcagcttatgtttaacgtcataaacaagctgttcgggtcctctttataatgtgcaaacggatcacaatattgaaaccctgctttttcatacaggcgtctggcggggagaaaagcctccatagaaccggtttctaagctgatccgctcatagccccgccgccttgcttcttcaagcatatggcggaggatccggttggctgcgccttttctgatatgattcggagaggttttcattgatttgatctcaccgtgccggctgtttagctcctttaaggcgccgcagccgagcaggacgccgttttccctcgcactccaaaacgtaacgtcaggctgacgcagccgggccgcattgagcgcgtgtatactttccgggggagaatgcatggtcatgctcttcagatgctcctgcaaaagcgcaatgacgtccggcgctgtgacatcgtcttttgttatgtccacttcaaaaccacccttgctgtgcatgttttctttgaacatagcaaaggttcacagcctgtgccattcccttgtacggaaatgtaacagggtatttgacctttccggtttcttgtacctatccaaaaatgaggcaatagttgcaatacatttctcgaaaaagcggtatcaaaaattggaaaacatggtataataattgtaacaaaatgttcaaaaaacgaccacaaaacagacacattttattctctgcatttcattttggaaacgctgccataaaatgaaaggagacatgtaagatggacatgttttttgcttatttactggtcgcaagcgcaacacccctctttatctggctggataacaaaaaagtcgctctttcggccataccgccaattattctcatgtgggttttcttctacttttacgcaaccagcagcctgtcccctctcggccacacactcatgatcatcctgtttgccgtcaacgtcatcgttgcccatatcgccgcctttatcatttacggccttccgcgcctgcgccggagaagaagccaataaaggcacaaaaaaccctcttcgcctgaacgaagagggtttctttttattcctgatgttcggaatgatgcttcgcaccgcccggagggtttccatccatatggtccccgtgatggtagtgcgccgcaaagatccagatggaaccaaggatgataacaatcgctccgaaaaatccgaagagcgtgtttccgacttgaattccgccgttttcgctttctgtcatgtgcatgaacatgagaagctgaaggccggcttggataaatgcgaatccgaaaatgatccacagttttgctgatgggcttaattccgtatataccgcaacccaaagggccagcagggtcagaataatagacaacgcaaaacctacgatatgcttccacggaaagtggctgtgttcagcagatttgtttgccatattatagtccccccaatccgatgagatagacgcctgtaaagatgaagatccaaacaacgtctaagaagtgccaatataaacttgagataaagatttttgaagacgtctgcggcgttaatccgcgtttcttcaattgcagtaagatgccggcaatccagaagataccgatcgttacgtgcgttccgtgcgttcccagaaggacgaagaatccagaccagaaagcacttgtaccgagagatgctccttcatgtacatagtggatgaactcgttaagctcacatccgacgaagcccgcaccgagaagaagcgtaatgatcgtccaaatgacgacgccttttaaacttccgcgacgcatttcatgaacagcgatcccgcaggtgaaactgctgatcagaagcaggaatgtcatgatcatgacaagcttcacttcaaataattcagccggtaagactcctcctgctgttcttctttgaagaacgaagaaggttgcaaatagtgttgagaacaacacaatctctgcccctaaaaagatccaaaacccgagaatattgagtctgccggtttcagattgatattccataggcgcgttagaattgccgtgttctgcatgttccataaatcacgcctcctttattcggaaatctttctttccgtctcttttatttcttcaacaggtatatagtagccattgtcatattcaaatgaacgaagcaccatgcaaagcagaatgccgatcaagccgacaatgcccatccagaaccattcaaacacaagtccgaagccagcaataccgaacgccactgacataataagcggtcttccggagttgtgcggcatatggattttcttgaacttgctttccggatgaatatccgttttgtcttctttcaattgcaggtacgcatcttgagatttcacttcaggaagcaccgcaaagttgtaatgcggcggaatcgcagatgaagtcgcccactcaagcgtacgtcccacgccccatgaatctccgctgatctcgcgagtagagtagcggaagctgtagtagatgttgtagcaaaggattaagaatccgacacccatcatgaaggctccgacagttgaaataaagttcaatgcagtccatccgtcattcggtccgtaagtgtaaatacggcgaggcataccttgcagccccaagaagtattgagggaagaaacatacattaaatccgatcataaagatccagaagaaccattttccgattctttcgttcagcttgtggccgaacattttcggataccagaaaataaatcctgcgaaacatgcaaataccgtacccgcgatcagcacatagtggaagtgagatacgaggaagtacgtattatggtattgataatccgctgcagccatcgcaagcataacccctgttaccccgccgacaacgaagttcgggatgaacgcaagcgcccacagcatcggtgttgtaaaactgatccggcctttatacatcgtaaagagccagttaaagattttaaccccggtcggaaccgaaatcgccatcgttgtaatcgagaagaaagagttaacggacgcactgttccccattgtgaagaagtggtgggtccatacaaggaaactcaggacggaaatggcgataattgagccgaccatcgctttgtaaccgaataactgctttcttgcaaacgctgaaataatttcagagaaaataccgaatgccggtaagataacgatatatacttcagggtgtccccaaatccagaacaagttagcccaaagcatcggcataccgccggcttccagcgtgaaaaagtgagcgccgaacaaacggtcaaatgataacagcgccaatgccactgtcaaaacagggaaggcgaatacgataataaccattgtaatcagcgtcgtccatgtgaacatcggcatacgcatcagcgtcatgcctttcgtacgcattttcaggatcgtcaccataaagttgatacccgtcatcagcgtaccgataccggcaatctgaagaccgagcaggtagaagttctcaccaggcccgggactcatgtcgttgcttgccagcggcatgtaactcgtccatcctgcgttcggagaacctccgataacgaaagaaatattgaaaagcatcgcacctacaaagaacgtccagaaactcaggttgttcaagtaagggaatgctacgtcgcgcgcaccgatctgcaaaggtacgacaacgttgatcagaccgattaaaaacggcatcgccatgaagataatcatgatcgtaccgtgagtcgtaaagatctcattatagtggtttgagtctaaaaaactgttattaggaagcgctaactgggcgcgcatcatcaagccgtcgaccccgccgcggaacagcatgataacagcagagataatgtacatgattccaagtttcttatggtctacagacgtcagccattcagaccagagccatttccactttttgaagtatgtgagtacaacgatgatagcgatagtggaaagcgcaatggaaacttgtgcgcccagaattaatgggtcacctgttacaaaaaattcatcccatctcaatttcattcgggcttcctcctttcttgttcaatttcaatcttgtttatcgtcggatactttaaattcgtttttctttacatcttcccacgggtctgttttagagtgcggtgatacggctttgtagccaaggcgtttgcgcgcctccatcgcatattcggcatcttggccgtggtcaacgtattttaagtgtgtagaagagaacgttaattttccgacattctccggaagcatcagttcgtcatacttctctttcgtcagctttggagaatcgctttgggcttttttcacccagctgttaaagtctttttgcgtaacagcttttacgttgaatttctggtcggcaaagtgttcgccggtgaagttcgcgttgcggccttcatatgttcccactttgtcagcttgtaagtattgatccatcagcattcccgccatcgcgtatttttgtcccccaagctgaggaatccatagcgatgccattgaatctgctgaagaaattttaaataaaaccggacggtctacaggaatgttcaggtagttaaccgtctcaatatcctgctcagggtagctgaatacccatttccagtctaccgaagtagcataaacaacaagaggctctttatcctttgtcgcttcaggcgctttttctaacgaatatatcgtctgtacggtaggcacagaaagtgcaataacaattaaaattgggatcactgtccagactacttctaagaacgtgttgccgtgcatctcgggcttgtaatttccgctgtctttgcctttgcggtcgcggtatttcactaaaatgattgtaaatagtacgaatacgacgccgacaatgaacagcataaatccgattgacaagagaatcagatctttctgctggtctgctacaggtcctttcggatctaaaacggaaatgtcgctgcatccgcccagtacgaaaacaacagccaacatcgctaataaaagtaacggtttaaatgctctgaacaagaagatcaccatccttcctattgatgtagtgaatctgaaatgtactttctcaaaatcttttctctatctaccttgttatgctatcaaaatctgcacttattagctttatttttttctaaagttcatctttttttcgacctaatgtcacaaaatcgtcaaaaaatgcatgaactttttccacttgcgtaaatcaaacataaaaagttttagatcatttagcatatatagagaaaaaagatagcgagaacgaataataccaaataaaggtttaccataataaaaatcgctggtcaacaaaaagtttcattttgttaaacattctacaaaagaaatattttttcctttgctcacaccttttcacacggtttccattttaacgcaacgcattgtgaaaaaaaagaccggaacgcgccttgatatgttcattataaaaaacgcattcatatgtttaatatggacaaaacgaaggaaacatataggcataaataataaaaaataggaagtgatatttatgggttttatcgtatctctgattgtcgctattattatcggctggatcggaagtttatttgtaaaaggcagtatgcccgggggaatcatcgggtcaatgatcgccggtctgatcggcgcatggatcgggcacggactgctcggcacatggggtcctcaccttgccggctttgccatcattccggcaatcatcggagctgcgatcgtggtattcttattcagcctgatcgccagaagcagaggataaaaaaaagcctcgtcccttatgggatggggcttttttccggtagagcgcccaaatggcggataaaccgccggaaagccgctctgccttcttctgtctgtttaaagacgccggcatgctccagtatccgcgcaaaggcatggccgatttcctctttcagaatctgttccgcgttttctttcgttaccttccgcttatgcagcacactgagcgcccaatctttatgctttgccgcagaagggtctgccgttaagaccgcttccgggtccggtgagcacagcgcttcagccgtgtatttcatttcttgttcaaggcggcccggcagaatcgcaagccccattacctcaatcagtccgatattttcttttttcaggtgatgaacttcctgatggggatgaaaaattcccagcggatgctcatcagaggtgcggttatttctgaggacgagatctaattcgaataaaccgtttctccgccgggcaatcggcgtaattgtattgtgcggtgtttctcctgaacaggcgaggagatcagccgcctcatcggaataaccgcgccatgcccgcaggatggcatctgccgcgccggaaagctcagacgcgctctcgctttgcaggcggatgaccgacatcggccacttcacaattcccagcaccgttttcggatagtcaggcagcctgtaccggctttctgtctccgcccgcgccatcgggaattcataatggcccccctgaaaatggtcgtggcttaaaatactgccgccgacaatcggcagatcagcattggaaccgagaaaataatgaggatactggctgacaaacgacagcagccggtcaaacgtttttttgctgatcttcatcggttcgtgccggtctttcaaaacgatgcaatgctcccggtaatacacatacggagaaaattgcagaaaccactgctcatcgccgagaatgaccggaatgacacgaaggttttgacgcgccgggtgatccgatctcccctcgtacccgacattttctttacaaagaacacatctcggataatcggattgaggctgctctttggcagcggcaattgctttcggatctttttccggttttgaaagattgatcgtgatgtccagctttccgtaagccgtctcagccgtccacccgacattccgctgtattctgtccgaacggatataatacacatcctctgaaaatcggtaaaacgcctttgtcgcctgctccggcccgtgcaccgcctttgtttcttcaaaacgacgcacaatctcggacggctgcggggcaaagcagcccatgatcttcgcgctcagcaggtcgcgataggtgtctgtatcgactgccatccggcccgtttctgccgcccattcataaatcggggccaatatgtccggcaatgatgccgacgattcattttctttctgttctgaagcctccggatgggtaatatgcaaagtttcatataaacggtttcttgtatattcaatatcaagaaatgaaatcagctctttttgcaatccgtaccggattaaacgttccacgtgccgctcaattgccatcgtcatccccctttagttctctcgctccgatatccgccgtgtaaaagtcagcttttctccctgtcttctcctcatagcggcccccgttagctctccgatgagattcactctgccgggcgcaaagaaaacgcgcaggtcctccgattccccgaatacatcagcaaacgctttctttattttgtgcttcatacgcatcctcttccaccattacactttccccccagggcgcagaaaaaaaccgttatgacacgccctcttctttcgcttttctgaagacaatccacttgctggccgcatagttgacgactacgataatgacgttatcggcgattttcgccaatgtttcgttcatatgaaattgactgaccagaagaatcatcatggcgagatcgatggcgagagacagcacccgcacgctgaaaaaggccgttaattctttcatcagactccgcattcccgcggtcttttgctgaaagacataccgtttattcgtaacataagcaaatagaacggacagaatccaagcggcgacagtcgccgccttgtaatccatctcaaatgccgacgtcagaatgtaaaaactgacgatattcacgatggtcgtgaatatccccataatgatatacatcataatttctctgtagcgcatggcagttcctcgctttctgaaagacttttctaaaccttttgtcaaatcaagaagaacgttaccctgattttctgccgctgacaaaaacatagagcgcgtcaaacatgctgcggaaagtaaccggccttcccagcacattggattgcttaatcatcccgtcgatgagcgcgcacatcatgttagcggtatgctcggtatctatatggtcttctattaaatttctcgatttgagccaatttatgtacatggtgctttcttctatccataacttataaagacggatataagcttcatattcactgacgactttgtaagtaggcatatgaacggcaaaagacacaacattccaggcaggcttgctgtttacaaaccgcatcaacaggctggccgcgctggccgcggcttcacaaagcgtcaacggccgctctgtttgcttttctagttcgtcgagatagccagtgatgatcctttttttaatctgacgcctctctaacaaatgcttcagaaaatcttccttgctttcaaaatgaacgtaaaacgcccctttgctgaaacccgccgctttactgatgtcatcgattgagactgaatcgtaagctctttcaatcaggagatgaaggcctgcgtcaataaaactttcaaatgtttcttctctcttaatttgaaatttgttttttttcattttttaccccagctgtttgatcattcactttatcttacaccgaatcattcttttgcggtattttttatgcaaaaacaatatgctattcgacgttttgagggtaaatattaataggtcatatggtttatttttatttgcatactatccagtcagtatttatttgtttattattatatgtaagaattcttgaaggattttggttatttcagtcattttcttagggaataggtaggtgaattcatcttcaatttgggattaccggccaactatgtgtgatatttgttatacattggctgctgtagctgggcaaatcaatttttcaattggaggttcttatgaaaactcatgtaatgaaagatatagatcaagattggcaattgttaattcaagaggctagaatcatgggtttgaacattgacgatgtgaggcgcttcttaaatactgaaaaagcggtgaagaaaaaaacaccaatgaaaaacaccatccgccagcggtaagattacaggcggatccttttactatatgacctgccacagtccgcccgcacccgagttttcaaaggaacacccgcaataagaggggaatcagagaacaaaccgtataccggacaaccattcccgtccgtattccgcaattgaacagccaaacatggtgatatgagatccccccgctgcatatcttgtgtattatgcccatttatgaggtgatacacagatggatacgaatccctattatgatgaaaaacaacagaactactacgaaggcctgaatccttatttattgaacaaaatagacgaaaactggcggacagtgcttgatgtcggctgcggaacgggcaatttaggagcagcgatcgaagaccgcggaataacggtttacggcattgaagcgtatcccgaagccgcaaaaaaggcggaaagcaaattgagccatgtgctttgcggcgacattgaatccgccgttcttccgtacgaatcagagcaattcgactgcatgctgttcggagacgttctggagcatcttgtcgacccgtggtcagtgctgaaaaagcttcgtccttatgtaaaaaaagacggcacggtgcttgcatgcataccgaatgtcggccacatctcagtcgtgctggagcttttagccggcaaatggacgtacagtgacgccggattaatggatcagacccacctgcgtttttttacccgggaagagactctttcattatttaaagccgccggctatgaggtcaaacgcattgaggcgatccgcgttgatcacccttcttaccacaaagccatcgcatcattgcacgaagtatgcgtacagcttggcataaggcatgactttatgacagaagcatcggcctatcaatatgtgattgaggccgagaggagcatgtaatggatgcacattcatttctgtttgtcgtctgtgtgaatgatgagtcgctgtactcccggtgcaagagccatatcatgcagcttaccgtccccccttcatactccgttgatatcttgccgatatacgattcagcaagcatggcctcgtcctacaacaaagcgctgaaacaccccaccaaatataaaatttatctgcatcaggatacttttatcattcatcagcatttccttcatgacatgcttcatatctttcaatctcatcaggagctcggccttctcggtgtcgccggctgcaaaaccctgccgccgaacggcatttggtgggaaagcggacagcggatgggaaaagtgattgaataccgggggaatgcttatcacccgctggattttgagcacggtgatgaagacggcctgtttacgcccgctgacgccattgacggcttgttaatggcggctcaatatgacgtggagtggcgggaggatttgtttcgcggctttcatttttacgacacatcacagtcgctcgaatttcaaaaacacggctatcaagtcggcgtcgcctgccagaaagacccttggtgccttcatttttgcggcgactcatttgacgccgcggcatatgaagcggacagacaaacatttgtcaaacactatatggcaaaaccctctcgctgatcgagagggcttttttcgggttaacgtttattcagttcccgctcaatgatttgttcaaaggtttcctttcccgccgcgccagggattctctcatcgccgatgataaacgtcggcactgccgtaatgccggcttcctcataagcatggcggagcgcttcccgctgtacgtccttgtacgctcttgtctcaagcgcctctttgaaggcagcgccgtcaagtccggcttcttccgcaagctttgtcagcacgccaacgtcaccgatattttgttcttcctgaaagaacgcctgaaaaacgcgtgtatggtattcgcttcctttcccatgttcctttgcgaaatgaaagccttcaaatgccaaatccgtgtaaggatgcggtgacacgcgggggaacgtgatttcaacgcctaacgactgcgccatcggctcaatggagtttttccacatctgctgcttggcgggatcattcaccggatcaagtttcggcgaggggctcggacgcaattcaaacggcatccattccacctgtacgtccttgtctttgatagcttcttcaaacgccgctttgccgacatagcaaaacggacatacataatcagaatatactttaatctgcagtgtcattgtaagtctcctttccttatcattttaagttgtaacttttatagttacaagtgtttttttaaaaaacaccttccatatggaaggtgtcacgattccagcagcctttgggcgatatattctccttttttacagcccccgggacaggcgaataaggaagagccgatcgtttgtgtgtattcattcagcgcatcctttgccgccaaagccttcagcatcgggacaaattggcggtccgggtctttttgaaagcagataaacagcaggcctgcgtcaacatagcccgtcttcggatcaattccgtccgtataggaaaatgcccggcgcagaatctgtctgccggttgattttgccatgctgacatgcgagtcggcgggaatttgattcagcttcacgggatcggtttcctttttttgtccgaaaggcgcgcccgagcttttcacccgcccgaacgtgtcctcttgttccttcaaggatgaacggtcccatatatctaaaaacatcttaattttcctaaacgccatgtacgtgccgcccgtcatccagtccggctctcctgattgaacccaaacgatcgaattcatcaggttttcatccttcgtgctttggttgccggtgccgtctttgaatccgaagaggttgcgcggtgtttctccgttttttccgccgcttaagaaacctttattgagaaagcggacttcacacacacccgatgcctgtttcatcaggttgcgcaccgcgtgaaacgccgtttgttcattatccgcgcagacctgtatgacgatatcaccgccgccttgtttcttatcgagcttgtcgttaggcatcggcggaatatcggcgaggtgcttcggttttttatctttcagtccgaagcggtccttcccgtctttctcgaaaaacccggggccgaagccgaaggtaacggtcaaattcgccggtgccagatcctgcgactccccggtatcctgcggaggcatatatttatttttctgttcgcctgaagggacggcgcctgaagtcagcagctgcgtcaagcttgtccattgtttgaaaagggagatgacatcggctttatcgcttgacatgacatcaaacgctgcaaaatacacatacgtctgatgcattgttgtgattcctgcttggtgctttccgtaaaaaggaacgatttgatcacgatcatgtttttcatcattcttctttgaagcggtggccgccggtttgaagagcggcgcgagtcctccgaggccgctcgctccgacagcgacggctgcgcccgcgacggcgccccacttcaggacatcccgtctgtggatctgtttttccttgttatgttcatcgctcatgctgtgtcttaactccttttaaagcacatcggcaatcttcgacatggtttcagaaagggccgtcagcttcgtgcttatctctctgatttgatctgtacttaatgtatcacaagacgtatacgattgatcgcacgttttgtatttcgacatcaaaacttcaaattcgctgaattccgcattaagtttttccgtgacctcgaaatggtctctcactgcgcgctattcacttttatagaggggttttgagcctgcggcgccggcggtgattggttcaggcgtcactttgagagaagcgatagagccgtcaaacgcttcggtcgatattgcaagctgattgctctgttcttgacatacagcttctattctccaagtccgtcactgcctttttgcgcacacagaaaaagggccgccctatcgggacagccctgctttggagcgccgaatttcctctgaaaacttccgcgccgccgcttttggatcttcggcttggctgatggcgctgatcatgctgacgccgtctgcacccgcttcaatgacgggcgccgcgttgtcagccgtaatgccgccgattcctacaatcggaatggtgatgccctgacgccgtacctcttcaatcaatgtaacgccctgcacggcttcagcatctttttttgtttcggtcggatagaccgggcccattccgacgtaatcggctccggcttcttccgcccgcttcacctcggagacgttatgtgctgacacaccgagaatcatatcgccgattgccgctctcgtttcttcggcgtctgcgtcatcctgtccgatatgcactccgtccgcctcaaggcgcaaggccaattcgacatcatcattaatgatgaaaggaatcccggcctgcctgcagacatcctgcacccgcttcgcgaacaggacacgttcatcccctgttaaagaaccgctccccttttcccgaaattgaaaaagcgtagcgccgccctcaattgcttttttcaccacggaaaccgggtctgcgcttgtattgtttgatcccataataaaataaaccgataacatatccttcatcatttcccgagaaatacgcgtcatttttctatcaccctttcaattgcggcaagctcggccgcttcttgttctgagatgcttgccagcttgtttaaaagctcaatctggaagctgcccggccccttatgggaggtgtccaaagcggcaagctgagcggcgcttccgtatacagaaacggctgaaacggccgcttgcagaacgtcctgccccgctgcgcagaaggctccgattacagacgtcagcaggcatcccgcccccgtcaccttcgtcagcagtttatcaccgttatgtacggcgtatgtatcggtgccgtcggagatgacgtcggtttttccggtaatcgcaatgaccgtcttcagcctgcttgcagccgtcttagcgagctgaaccacatctcctccggcttcccccgcatccacgccttttatcttccaatcaggggcgccggcaatattggcgatttccgcggcatttccgcgaatgacggacaagcggacctcctgtatgatcttgcgggctgatgccgtccgaaacggtgtggcgccggcgcctaccggatcaaaaatgaccggaacaaagttttcattggccgattttccggctgcgatcatagcttcaaccgacgccgagctgagggtgcctatgttcaggacgagcgctccggcgattttcgccatgtcggcggcctcctcaattgcataagccataacgggcgatgcgccgagcgcgagcagtccgttagcggtgaagttcgtgacgacattattggtgatactgtgaacgagcgggttttgatcccgcactttactcaagtgttgagctgcggtttgtgcgtccatgtctaatcatccttttttctctttttcggattccataaatacgatttcgtatgctccagccaggctctggcggcaaaggacatatagcggtctttccgccaaatgatggctaaatgccacggaatgaccggatgaacgagcggaatggttctgactttgtcaggatcaagaccgcggcagattctttccggcagcaggccgataccgagattggcggataccatttcgctgataaagtcccactgtgacgtttcataaatgacgtgcggcctgaatccggctttcacgcattccgtcataattcgattatgaaggacaaaatcctccctgaaaaatatgaacggctcttctttcaattcatgaagactgcattctttctcgtcagcgagccgatgtgacggatggacgacgagcataagggtttccttgacgattgtgaatgtatgaaaaatctcttcattcgcgggaagcacgacgaccccgatatcaagcgagccgtcctccaccccttgctgcactttaatagagccgtcctcaacaagctgaaacgtcacatcgggatatgtgacgcggaagtcaccgagcactctcgggaaaaagccggacccgatcatcggcggaagaccgatgcggacgtgccctttcttcacttccataatatcgttcagctctgacgtcaggttttggaatgactttgtgatttcctgcgcctgcacatacatgctctgcccggcgtcagtcagttcaacttgccggccattgcggtaaaacagcttaatgccgagctccgtctccaggtttttaatcatttttgagattgtcggctgtgaaacatacagcgactgcgaagccttcgtaaagcttttcaaacgggccacttccaagaaatacgttaagtgccggatatccattacatttcatcctttctatagacaaaaggaatacatattattctttatatgtattttacctatagcaaaaccttctgtacaatataaatataagggaggcatcattatgaaaaaattgctgcttaccgttattcaaatcgctctgctgtttatatttgcgcgtctgatcaattgggtcacggcggctcttcatataaatattcccggcagtataatcgggattgtgattcttttcacattattgcacttcaagattatcaaacttgaatggattgagcttggcgcagcatggctcctcggtgagctgctgctgtttttcatcccgtctgccgtcggagtgattgaatacggagatattatgtctaaattcggcgtaagcattttacttgtcgtcgtcatcagcacatttgtcgtgatggtttcaacaggtacgcttacacagctgatagcaaaaagaaaggagaaaaaacaaacgtgttcatcggaatcataagtttattcttaactgtcttagtgtatttgggcgcgaaaaaactctacattcgttttccgcgggtgtatacgtcgccgcttctgattacgcccgctgttttggtcgtactgctgcttcttgtcaatgtcccgtatcagacatacaatctcggcggcggactgctgaccgatatgcttcagccggcaacagtggcgttcgccatcccgctttataaatatttcccgattttaaagaaatacgccgtggaaattattttgaacgtagcggtcggttcatgtatcgccattttgtcaacagcctttatcgcaaaatggttccatctcggcagcagcttagtcgacagtctcgtgccgcgatccgtgacgacgccgattgccatgaacgtttcagaaatgatcggcgggatgccggccgttacagcggttttcgtcattttaacggctttattgggaacgatcatcgggccgatggtcatccgctatttccgcattgataacgaaattgcccggggcgtgctgctcggaactagcgcgcacggagcgggaacatctaaagcatttgagctcagctccgtatcaggaacgatctcaagcgtgtcgatgatcctcgccgcgattatgacactgtgcgcggccccgattttgctttcgtttatgtcataaaagactgctccttacagagcggtctttttttagttgccatgaagaattgatttgtctgtccttcataaaaagacgaaaacacgatatgataagacatgaagtgaaaagactgaagaacggatgtgtcatatgaacggccagcagcgaagcagcatcagaaaaggacttgaagtcgatatcgtcctgaaagccgatcagcgttcaggaaagctgacaagaggaatcgtcaaggatattttgacgaactcaagcttccacccgcgcggcattaaggtccgccttgaagacgggcgaatcggccgggtgcagcacattattgaatagaaaaaagccggagcttcacgcccggctttttttctttaatttcagcaatgaaatcctcatatgttctccctttatatacaaaaatctttaaccaactattgactcttacgttgcgtaatactttagagtagccattaaggaggcggcaaacgtgatgggtatgaaagtaaaagaagtagctgacctgattggagtaagcatacgcactctccatcattacgatcaaattggattattgactcctcaggaaacgaccgattccggttatcggctttattctgaggagaatcttgaacagctgcagcagatactatttttcaaggagctcgatttctccttaaaagagattaaagaaatccttactaatccttcatttaaccgaagggaggcattcattttacaaaagaaaatgttgattgagaaacggaatagagtcgataagatgattgataccatcgataaatcaatcaaacatatgatgggagagatttgcatgacgaacaaagagcggtttgagggaatgaacttcaatcataatctttatgaacaagaagcccgcaaacggtggggtgatcaacctgtcgataaggtaaatattagattgaaaaacatgactgatggtgagcaaaaagatttatctgataagtggactgcaatgttcaataaatttgcactccttattaaccaatctcccgagtccccagacgtacaaaccgctatcaaagagtggtttgattttctcaatgaaaattttggtgaatattcttttgatgccttttacggattaggtcaactctatattgaagatgaacgcttcactaagaacatcgaccggtatggtgaagggttggcgaagctcatgagtgatgccattacaatttatatagatactcaaaaaaagggtggtgcccattaaaatcattatcgaggatacaattgggcggagggattagtgaggccactttacttggcacagatgagatactaagtaatagcgggttttttctttaaacagtaagatataaagattatttatcccggattagagcgatggaagagggttttcttttcccctctttccacgctataaatgaccatcctattttttccgcaagaaaacaaccttcaaatagttcccttctttaaacgcgggaatcgttttgaaatcttccggaagcgtgtattcttccaaaatgtcgtaacgctcatttgtttctttaaaggcggtctctataaaatctttaaatttcttcatattgaaggcgctgctgtttgtcgaagcgacgatgatgccgttttttgcggtgatggcgatcgtttccttcagcaggtttttataatctttcgccgcgctgaacgtccgtttttttgtgcgggcgaaagaaggcggatcaaggatgatgaggtcaaacgccagcccttttttctccgcatagccgaagtatttgaaaacatccatgactttaatgtcatgcgcctcataatcaattccgttggcgctgaactgttcaatcgtttttccgagactgcggttggcgacatcgacgctggtcgttttctcagctccgccaagcgccgccgcaacggaaaatgcccccgtataagagaacgtattcagcacccgtctgccgtttgcatacttgtcccgaatcgctttgcgtacatgacgctggtctaagaaaatgcccgtcatcgccccatcgtttaaatccaccgcgtaccgtatgccgttttcttgaacaatgaccggaaaatctcctctttcgcctttgacaaaatcgtcgtcttccacgtattgcccggcagtatcgaatcgtttcttttcatagatcgctttataagaaagctccagtccgtcaatcgcctcaatcatgctgtccttataagcgtaaatgcctttactgtaccattgaatcagcagataaccgtcataaaagtcaatcgtgacgccgccgatgccgtcgccctcaccgttgaaaagccggaacgccgtcgtatcgggcgccttaaacagatgagctcttgcttcaaccgcttttttcagcttgtccagaaagaaacgtccgtcgatccgttcatctctcgcgcgggacagcacccagccgactcctttattctgcaaaccgtaatagccttttccgataaactcacccttctcggatgtcacatcaaaaagatcgccctctgttaaatgagccgagcttccggacagagcgtctttttcaatcagggggaatccttttttcagctttccggcaaatgtatctttcactgtaagtagcttcattgtgcattcctctttcgttttgctttctcttatcgtaccataaaacatgatcaacaccgcattgtcccgaaaaattcaaaacagggggaaaaccatgacagccaaaagaatcgaccatacaggcattatggtcaaagatattgaaacatccatcgccttttaccaagacgttctcggtatgcagttaaaggatcgtatcactcatacgaacggcattattgaacttgcctttctcggctttcaagaagggccggagacagaaattgagctgatccagggctacagcagcgagcttcccgcagaaggaaaagtgcaccatgtcgctttattgactgaagatatcgcagcggagttcacgcatgcgaagcgtcagggcgccgtattcattgatgaagaaatcacgacgcttccgaacgggtaccgctacttttacattgaaggacctgacggcgaatggatcgaatttttccagcgttaaaaaaacgggcgaaagcgcccgtttttttttatgtttcttctgtgacgttttgttccgccgcccgttcctctctccatttttgaagatcccaaattcggaaaaacggataataaatgataaatgtaatcaggagattgatcaactgcatgaccgaaccggagattttcccgcccgtcgccaaataaccggaaatcagcggcggcatcgtccacggcacggcgattcccgccggttttgccaccatccccgtgctcatcccgatgtacgtcgccgtaatggtcaagagcggcgcgatgataaagggcacgattaacagcggattcatgacgagcggcatcccgaaaataatcggttcgttaatgttaaaaatcgcgggcccgatgccgagacggccgagctgtttcatctgtttgcttctggagcgcacaagcatggtcagcacaagggcaagcgtcgctccgcttccgccgacattaatccatatttgaaagaactgtgtcgtaaaaatgctcggcagcgcttctcccgcctgaaaagccaaacggttggcgtccatcgccccgtaccagatcggcgacatgacgccgccgataatggacgcgccgtgtatgccgcacgaccaaagcagcatttgcacgaattcggcgataagacttccgccgagactcccgcccaaaatagagagcggggtgcccagcagatcgcctacgacattgtggagacttttaaaaggagttatttcaataaacagacgggccagccatacaagcgtaataataatgaaaccggggatgagcgcaacgaacgatttgctgaccgcaggcggcactccgtcaggcatcttaatgacgatatttctttgtataataaaccggtacacttccgtagacagcattgcaatgatcatcgcgacaaacagacctttgcttccgagcagcgaaatcggaatgccgcctcccaccataatctctgttgacgaaccgtcagggataaacggaatctgatacggcgtcgccaataaaaaggcggcaagggcaatggctcccgatgacagggcatccacctcatagctttccgcaagccggtaagcaatcccaaaggcggcgacaagcgccataatatcaaaggacgcattcacgggatacccgagcttttcaacccaattttcaccgaaaagaccagccataaaatcggcataaccgggaatcggaagactcgtcagaatcagaaaaaccgatccgatgatgataagcggcatagtcaaaataatgccgtcccgcaaagctcttaagtgcctttggccggcgacttttccggcgacaggcatgattttttcttccatgacccgattgaacgtactcatttatcaaaaaccccctttttgagttcattgcgcagatgtcttaaagcattttctccatcatattttggaaacgcttacatttgcatacagaaattttccttatccctcaggaaaaaaagaattccgcactgccgatatataaagaaaaagggggaatcgcaatgtatcacaccctgaaaccgataatggccgcggccttgtgcgtcggactgttctccgccgcggcgcccgcgcacgccgagacgcacgaccgggacgttatcgtggtgtacaaaaatcaaaacggcaaggaatccgccatagacagcggagcggatgtggaacagacctatcagcatctcccggcagtcgccgtgtcagccgattcgcaaacggtgaaagacctgaaacaggaccctgacatcttatatgtagaagagaatgtatcctttcaggcagcaggcggttctgatatccgcccgttatcagcggcccaaagcagcagttacgcgctgccgcaatgggatatcgaaccgactcaggtcaagcaggcgtggaaagaaggcttgaccggaaaaaaggtgaaagtggctgtcattgacagcggcatttaccctcatgatgacctttccattgccggaggctattccgcagtcagctatacttcctcatacaaagatgacaacggacacgggacgcatgtcgccggaatcattgcggccaaacatgacggatacggcattgacggcatcgcgccggatgtccgtttatatgcggttaaagcattggacagaaaaggtgcgggagatcttaaaagccttcttaaagcgatcgactggtcgatcgccaataaaatggacatcatcaatatgagcctcgggacaaacgcagacagcaaaagtcttcacgacgccgttgacaaagcttacaaaaaaggaatcgtgatcgtagccgccgcaggaaacgacggcaacaaaaaacccgtcaattatccgggcgcctacagcagcgtaacggcagtctcagcgtcaactgaaaaaaacgggctcgcgtctttttccacgaccggaaaacaaattgaatttgccgcacccggcaccaatattacgagcacatatctgaatcaaatgtacgccacggctgacggcacatctcaagccgcgccgcacgtcaccggcatgttcgcgctgctcaggcagaaatatccggaggaaacaaatacacagctccggcagcagatgcagcagaacgtcaaagatctgggcgctcccggacgtgacagccgattcgggtacggactggcgcaatatcacacaaagcaaaagagctttgccgaacgggccgtaataaaagcggaaaaaacgaaaaagcaggcagatatcaatgaagcaaaaacggctgtcagcaagctttccaagtcaaagggaaaaaccgctctcgaggcgcggatcaataaagttcagacggcaagaaatgtgacggacgcaagagacaaagtccggactgccgaaaaacaaaagaaaaaaaccgccgtcaacgccgcacaaagcgccatccgcaaattaccggccggttcagagaaaaaagggctgcaaaagcggctgaacgctgtcaactcaagccttttgagaacagctgaggccagcgtcaagcaggcggaaaaaaagacctctgaagccaacaccgcaaaagcccaaaaagcagtcagcgaaatccagccgggaaaagaaaaaaccgctctggaaaaacggcttggccggataaaagataaactcaaccggcagcaggcaagggacaaagtaaaaacggcggaaaaaaccaagacgaaaaaagcaaaatcagcggcgcaaacggcagtcagccgattgaagccgtctgccgaaaagaccagcctgcaaaaacgcgtgcgtgcgattcgggtgaaataataaaaaaacgcttgtgagccggtcaacggcttcacaagcgttttcatcacacctgcctattggttcatggccgggcggtcaatcgtgttccatttcgtaaaggacatatatcggaaataatgatcacgatacgggtgcgaagtgcctgtattccaaggcttgtccccgccgcagaaatggacgatggccggttcggcacgtgtttctctgtaacgtatacggtcgatcagttcaggaggcgttttctcattcatgataatatgcgtctgagcgttccagcgcggatgcagttcatgccattgatcatataagatcgcgttaagcgcgtcctgatcatgaaacacgagaaaatcctccgagctgttatcattgataaaatcaatcacttttttagaaatattctgtgttctccaaggttcgaaatctataatcataataccggaattaaaatacttggcagtgtcgctgatattcatttttttcagtctttcatgctgtccggcatcttctaccgccgcaactattgccggggaaatatccaagtcccataaaaccgaaatatcttccatcacaattgcatcgcaatcgatataaatcatccgctttacggactcatccttaattaaatcagggatagaaatgcggtaataagccgcttttgtaatgtggctgctttcgactgcatgcttgtattgatcagcgtctacttctaaaaattcaagcggcgtcccgaatgacatcgcggtctgttcaagcttgtccttgttttcggcagtaattccgccgtcgatcacatataatttggcattccttgttttatccatattcatcaataaagaagcgaacatcccacccaaatgacgagcataattatcatcggcacatgatacgatatgcattgtttcattctttcccactgatattcatctccctttttgttgtacaaatgtctttcccttttttaaaaaagtaaacctcgatcttacacattttttctgcgggaatgtgctgtttgcgatttgatatctattgcattctctgttcaaattcaatcaggatttcagcctgaatcatcgtcagaatacatcgtgcgggaaagcgaaaacacctaaacataaaaacaaccagccggactgcgtataatagcggtccggctggttgtgacgggtcaatcgtttaatcgacttctttcttaatcccaagcatcttttcgtctaaataatgggcgatgtccgccgcttccttcagctcgtcggtcagatgcttcgggacttcgttatttaatttgtaataaattttatgttcaaggctcgcccaaaaatccatggcgatggtgcggatttgaatttccgccttcacatattccacacgattcgtcaaataaacgggaatttcaataatcaaatgcagactgcggtagccgttcggcttcggatgtttgatataatccttcacctttacgatcttcaggtccttatgctgcttcagaacctcagcgacattataaatatcggaaataaaggaacagataatcctgacacccgcgatatcatgaatatgctctttcatttcctgcgtcgtcacatcgcagcctttgcgcatcagtttattgacgatgctttcaaaacttttcacgcgtgattttgtatgctcgatcgggttatgcccgtgaatcagattatattcctggctgatgatagaaaacttcgtatccagctcatctaaagcaaatttataaactaataattcatttttccaatcttccatgaccgtttttaaatcatccatatgggctgttgacaagtccatttttttcatctccttgctttgctgtccatatatgagacgggtcagtccgcggtcaggttctttacaatatcgtgaagattatgtcataaaaaaaagcaaatgccgattatggcatttgccctttcatttgatcagcggaaataactgatcaggagtccgattgaaagcaggaatccgaagaatgtattggtttgcgccgttgatttcatcgcaataatcatgttcatcggcatttcgtttttcacaaagcctttcacggcctgaacgggtttcggcacgctcaaaaagaccaggaacagccacgggcttgtgtaacccataatgacaagaccgacgatccagatgtaagcgatggcaaaagatgcggccagtatcataacggcccctctatgccccatcaaaatggccagcgttttacgtccgccttttttatcttcctcaatatcacgaatattgttggacaggttaatcgctccgaccaggatggcgatcgggatggaaatcaaaatgctctgttcattaattctgcctgtctgaatgaagaaagaaataaggacaaatacagagcccatgcaaatgccggagaacagttccccgaacggtgtatacgcaatcggcagcgggccgcccgtatacagatagccgatcagcatgccggcaaggccgatagccgcaagccaccagctgctgctcatgcagatataaacaccgagcacgagggcaatcgcataagagccgagcgccagctgcagaattgttttcggcttcatgccgtggcggacgatcgctccgccgataccgacggaatcctccgtatctaaaccgcgtttaaaatcgtaatattcattgaataagttcgtggcgatctggatccaaagacaggaaaacagcatggccaaaaacagcaggaaatcaacctttacgtaaaacatcgccaatacggtgccgagaagtacgggcacaaacgatgccgtcaatgtatgagggcgggttagctgccacaaaatgcggcccatgctttctttctcgggcgtcttttggctgccccccatattgttttgattcattttcctcttcctttctattaaaaggctttcacagtcagccgataacagtagtgttgaattggggttttcacgttttctgctaccttatctatcataataatttcttcctcatttcacaagatgcggcgctttatcagctatcctgccggaaacggcttttcgcccttctccattggggttcggcacaagcctgcttaagaaaaagccgccaaaatttttttacctcgtttatatttacgataagttaaaaatcccgcctgaacagcgcttttttagtatgatcattttccaatttatacatgcgtgttttccatccttttgtttctcattcatttttaaggaaattttaagcttaggatattagacatattttgaaactttttgttaatctaatcgtcatatactggtgtaattattgaatacgcggggaaggaattttgaatatgatgcaaaaattaaaacgtgcttatgaaaatacattgatcaaatggacgtttcatacgggcttttattttctgatattagtattgctcttttggatgtatggatttcatacagcgaataccggcacttatatttacaacgatttctaatcggggaggataactatgaaactacttgatgctataaaaacatacgcagacgccaagccgcaggccatagcgtttcgttccttagatcattccctcacttacggggaattatgggatttgtcggagcgggttgcgtccggcattcaaaaacatacagctgacggttcgaaagcgcctgtcctggtttacggacatatggagccgaatatgatcgtttctttcttgggaagcgtcaaagcgggccgcccttacatccctgtcgatgtttccattccggcggagcggatcgtcaaaatcattgaaagctcaggcgcagagctgcttatcagcgtatcgggcgatgcagtcgatacgggaagcaatctgattaaaaccgttacgcccgaagagcttgcagctgacggagatgcagacctcagccgtgagaactgggtaaaagagctggatacgttttacattatttacacgtccggcagcacgggaaatccgaagggcgtacagatatcggctgataacctgcaaagcttcactgactggatctgcagggattttcctgtgggcgggggtaagacattcttaaaccaagctccgttttcttttgatttatctgtcatggacattttcccgtcgcttcaaacgggaggtacgctgcactgcgtaacgaaagacaaaatcaataaaccgaaagtactatttgaagagctggagaaatccaaactgaacgtctggacatcgacgccgtctttcgtccaaatgtgtctgatggaccccggctttacgcaggagctcctgcctgaggcagaagtatttatgttttgcggagaagcgcttccggctgccgtggcacaggaactgttaaaccgttttccgaaggcccgcgtattcaatacatacggcccgactgaaacaacggttgccgtcacctccgttgaaatcacgcagcagatcatcgatgaaaatgaatccctgcccgtcggttttgcaaaacccgatatgaatatcttcatcatggatgaaaacgggaataagcttccggacggagaaaaaggggaaatcatcatcgccggcccgagcgtgagcaaaggctatctcggtgaaccgtctctgacggaaaaagcgtttttctcaattgacggccagtgggcatatcacacgggtgatgccggttatgttcaggatggtcagattttctgccaaggacgccttgatttccagattaagcttcacggctaccgcatggagctggaggaaatcgaagtacatgtaaggcagtctcaatatgtgcgcacggcggttgtcatcccgtatcagcctaacggaccagtcgaatatttaattgccgccatcgtgcctgaaaaacatgattttgaaaaagaattccagctgacaagcgccattaagaaagaactggccgcttcgcttccggcctacatgattccgagaaaattcatttatcaggatcacattcaaatgactgcgaacggaaaaatcgaccgtaaacgcattggcgaagaggttcttgtatgacgccttacagctcgtttttcttctttatcttacttggaatccttcttttgccgacgattattttagggctgaacggcaagagattccaaggatacaacatgtttatatccatcatcgtattggctttgattttcgcgcatgatctgcacggcgtgatcgcactatgtatctttacgctgtggcaggtgcttttaatcaggggttatctcgcttacagactgaaagccaacagcggctttgtcttcagtatggccgtgatcgcgtccattttacccctgtttttatctaaattatggccgtttttcttcccgccggcgcctcatcatccggttcataacctgatcagtttcttaggaatttcttatttgacatttaaaggcgtccagctgatcatggaaacgagagacggactgattaaagaaaaaatgccgcttcaccgccttttgtactttattatgtttttcccgaccatttcttccggtccgatcgacagataccgcagatttgccaaggacgaacagaaagtatggacaaagggagaatacgctgatttactgtataccggcattcataaaatttttatcggtttcttgtacaaattcattatcggatatgcgattaacacgtatttcattatgaatctgtctcatatcacccacagtaaactgtggggtaatgtgctgtacatgtacggatacagcttgtacctgttttttgattttgcgggttacacgatgtttgccgtcggtgtaagctatattatgggtatcaaatctccggaaaactttaataagccgtttatcagcaaaaacattaaagacttctggaaccgctggcacatgtccttatccttctggttcagagactacgtatttatgcgctttgtattctggatgacaaagaaaaaatggataaagaaccggatggccgtctcgaacatcgggtatttcctgctgttcatgctgatgggcgtctggcacggactcgccctgcaatatattgtatacggcctgtaccacgccgtattaatgaccgggtataacttttttgagaaatggaataagaaatacaagtggctgcccgccaatcgttttacggcctttttagccatcgtcatcacattccatttcgtatgtttcggattttatattttctcaggaaaaccatttcatcactaaaggagattgaaaacacatggaatttaaacaggaagtattagacgtattagctgaagtttgtcaggaagacgctgtaaaagaaaatcctgatattgaaatctttgaagaaggactgcttgattctttcggaactgtagaactgcttgtcgccatcgaaaaccgcttcggcattacagtgccgatcactgaatttgaccgtgacgagtggaatacgccaaacaacattgtaaacaaactgactgagttgaagtaaatgaaaaagcgtttctttggaccaattattttagcgtttgtcctgtttgtcggagctatcgcagttccagcttcatggcttacgcgcttcattcctgaaaaacgtgtcgaagagtcggcagcggccttaaatccgaatatgttccaggggctctatctgcaaaacaaaatgttcgaagactcgaagtatatgccgattttcggttcttccgagctttcaagactggatgagtttcatccgtccaactatttccaagtgaacaaccaaggctttacgccttatcttgtcggaaaaggcggttcgcaatctttaattcatgccataaattttgccgctcatgctgatcagcttaaaggcagaaagatggtatttattgtatcaccgcaatggtttacaaaacatggttcaaatgagcagcattttgctcctaatttctcatcattgcaagctcttgacttggcttttaatcgcaacattgagccgagactgaaaaaacaaatgatgaagcgtatgctgcactacaaagttgtacagaatgatgcaatcctgtctgaactgtataaagcgtctgtaaaaggtcagacttggaaagtaaatgcattaacaccggctgcgaagctttattataatatcttagaaaagaaggacctttattattcgatagaagagccgcaaggaccaaaacgtttcgttaataataacctaaagggaaagtcctggtcccagcttgaaaaactggctgctcaatatggtaaagatcacacgcgttctaatccgttttttatagacgattctgtttataaaacgatcaaaaataaagtgcctaaagccaaaggttcaaacaaaggcagaacatacgcctataaaaagtcactggagttcagcgattttgaagatatgcttactattctgaaggatgccggcgctaagccgatgttcgtcgtcattcccgtaaatgggaagttttacgactacaccggcttcccgaaaaaaggccggactgattactacaaaaaagtcactaagcaaattaaagcgaagggctttcaggttgccgacttatccgggcacgaatatgatccgtactttatgaaagacaccatccatatcgcctggaagggctgggtgtacgtcgataaagcaatggagcagttttacaaaaccggcaaggtgacggttcactgagcacagtgatgacagaatacgtaaaaacgaacacgcagggggcattctctcccctgctttttatgtgatttgattttttcacaaatttgaggaaaactattgcgaatatttgttgaaggtatacaatagaatataaattattttcaaataagtttgacaataacaccaatagggagacagaacattatgaaacaagacattcgtgttgaattgacttcagccaaaaaaccgaaaccggacccccataaccttgcgttcggcagaattttcaccgaccatatgtttgttatggattacgacgccggtcaaggctggtatgatccgagaattatcccttatcagtccatctcaatggatcctgcggccatggtttatcattacggccaaaccgtttttgaagggcttaaagcgtatgtaacgaaggatcaggaagtgcttctgttcagaccggagaaaaatatggagcgcctgaaccagtcaaatgaccgcctttgcatcccgctcattgatgaagagcttgttcttgaaggcctgaaacagctcgtagccatcgaccaagactggattccgaaagcggaaggcacttccctttatatccgtccgtttattattgcgactgagcctttcctcggtgtagcggcatcccatacgtacaagctgtttatcatactttccccggtcggctcttattacaaagaaggcattaaaccggtaaaaatcgccgtggaaaacgaattcgtgcgcgccgtcaaaggcggcaccggaaatgcgaaaacggccggcaactacgcttcaagcctgaaggcgcagcaggttgcggaagagaagggattttcccaggttttatggcttgacggcattgagaaaaaatacatcgaagaagtcggcagcatgaacatcttcttcaaaatcagcggcgaaatcgtgacgccggagctgaacggaagcatccttgaaggaatcacgcggaattccgtcatcacccttctcaaacattggggactgactgtgtccgagcggaagatttcgatcgatgaaatcatccaggcgcatcgtgacggccgattggaagaaacattcggaaccggtacggcggcggtcatttctccagtcggcgaactgatctggaatgatgaaagtcttgtcatcggcagcggtgaaaccggagagatctcgaagaaattgtatgataccattacaggcattcaaaaaggcgcggaagccgacgtgttcggctggacgacgaaagtcgcctcactaagcgaatcaaaataagcaaaaaacccggaagcgaatccgggtttttttactgctcttatgcttcaatcgacttaaagaaatggggcagatgttctttgtgggcctcaagcatttcatccagaatggcctttgccacggagtctgacgggacaagagggttgatcgtcatcgcaagaagcgccgtttgataatctcccgtgacggctgcttcagcggcgacgcgctcaaatgatttgatttgctggacgagtccgcggacagacaccggcagatcaccgacggcgatcggtttcggaccgtctttcgtcatgacgcagttcacttcgaccgctgagtcattcggaatgctggcgatcgcgccattgtttatcgtattgacgggctggatatcatgtttgtcgttatagatggagctgatcaggttgcaggccgcgtcactgtagtacgctccgccccgtttttccagctgcggcggtttgatggcgagattcggatctttgtacagttcgaacagttctttctcaaccttctgcacgacctcggcgcgtgtgccctccgtctgtgacgcttctatttcatgctcgagcatttctttcgttttgaaataatagcgatggtagccgcaaggaatcagatcgagcgccttcaggaattcaggctcccattccgctccggagatatttttcatcgtcatggcgttttccgggtctcccatggcttcaatgacttgatccttcacactgacgccgtctaagaaaacatctaatccgaagaccatgtgattcagcccggcaaattgcacttcgatccggctgacatccacatccaatgcttttgcgacgcccattttaatgccgatcggcacattgcagagaccgacgacttttgtaagattcgagtagcggagcaaggcctcggtaaccatgccggcagggtttgtgaaattcacaagccatgcattcggacaaagctcttcgatgtctttcgcgatttccagaataaccgggatggtgcgcagccctttgaataaaccgcccggaccgtttgtttcctggccgattacgccgtattttaacggaatccgttcgtctttggcgcgggcctcaagaaggccgacgcggaattgagtcgttacgaaatcagcatccttcaaagcttctctccggtcaagcgtcaggtgaatctctatcggaacgcccgctttttcgaccatgcgttttgcaagcgtgccgacgatattgagttttttctcgccttcgggaatgtcgacgagccataattctctgacaggcagttcctcatagcgcttaatgatgccttccacaagctccggtgtatagcttgaacctccgccgatcgttacaattttaattccttttgtcatatttttgctcccccttgcagactcactttttcgtaaatctcgactaactcagcggccaagtctttcacggtcatggcattcattaaatgatcctgcgcatgcaccattaaaagcgtcatgtctgttttttctccgccggcttcattttggatcaattctgtctggtaatgatgggcttcggtcagttcccttgcggcttcctgaagcttttcctcggccatggctctgtccccccgctttgcggcggcaatggcttccattgatgcgcttcttccgttgccgccatgcaggatgatctgaaaaatggtctgttccattttttcattcatgtgtttcactccctttctctacagcacggctttttcgtctccctgtacggctggcgcctgcgattgttcaagttcgttttcttctttcagcttttgcgaatcccacattctgaagaacggatagtacacgataaaggctgtgatgatattaatcgcctgcatgacagcccctgatatttttccgcccgtggcaagatagccggagaaaatcggcggcatcgtccatgggacggcaatgccggcaggtttggcgacgaggccagtgctcatgccgatataggtaaagaccagtgtgacaagcggtgtgataatgaacggaatgagaagcatcgggttcatgacgatcggcattccgaaaataatcggctcattaatattaaagacagccggcccgatggcgagtttcccaagctgcttcatctgcttgcttcgcgaacggagaaacatggtgaccacgagcgccagtgtcgcgccgcttccgccgatgttgatccagatttcaaagaactgctgggtgaaaatattcggcagcgcatcgcccgcctgaaacgcaatccggttggcatccatcgctccgaaccagatcggcgccatgacgccgccgacaatgttcgccccgtgtaatccgcacgcccacaagagcatttgaaccgcttcggctaccaggcttccgccgagacttcccccaagaatcgagagcggcgtccccagtacaacgcttacaatgttatgaaggctttcaaacggcgtcgcttcgacaattaaacgcgcaccccagatcagaaagatgacggcaaagccgggaattaaagcgacaaatgatttgctgaccgccggaggcacgccgtccggcattttgaagacgaaattccgctggatgatcaggcggtaaatttccgtcgacagcatggcgatgatcatcgcgacaaacagccctttgcttcccatgagagacagcgggatgccgccgcccaccatgatttcctctttggcgccggaaggcagaaacggaattttgtacggcgttgccaagagaaacgctgccaaagatatcgcaccggccgataatgcgtccaccccatatttttcggccaggcggtaggcgattccgaaagcggcgacaaggcccatgatttcaaaggtcgcatcaaccggatattgcagtttttgagaccaggcgcttccgaacgtctttgccatgaaatccgcatatcccggaatcggcaggttgccgatgattagaaaaaatgaaccgatgatgataagcggcatggtgaggatgattccgtcacgcagtgcttgcagatgccgctgggaggcaatttttccggcaatgggcatgactttctcttctaaaaactggttcaccttattcacacggcccgcccctttctacgatgcgtttccgagctgttccgctgatttcagaacctccgctccgttgcaagtgccgtaatggacggtattgatgacttcaaccggcactccttttgattcacccaattttttcagctgcggaagcaaataacggacttgaggcccaagcagcaatacgtccgctttatcaatatgctggttgactgaatcgcctgacaccgcccagattttatattcttttccttgttcctgcgcgcttttttccatcttggtgacgagtaagcttgttgacatccctgctgcacaaacgagtaatatattcatgtaaaagacctcctgaaagtttgatattttgtatgtctcgatgttagtaccatcatattatgaaatcgctttcataactactcaggctttttccgctgctaacggaaaaaaggtgctgatcgtttgtctctgaatactcgtaaaacctcctgataggttgtgcattttaagagacggcttaccgcggccggatcatccaacatcccgccgagccatttgtacatatgctggaggtcggctttgctttctttctcgacgcagagcaggcagacaaattggacacgcttatccgcccagtcaatcggcttcttcagcgtgcataccgcccaaaacgtcgtgtctgtctgcggaacgagcgggtgcggaatcgccgtaagattgccgaaactcgtaggagaaatcgcttccctttcaaaaatagaatcggtcagagaatcagaagcgaggccggcttctgcaacctgctgtccgagaaaacggatgacgtcctccttcgtctccagatcctgctgcaaaaataccagctccggtttcagaaagttcaattgttcccggttttcttccagcatggcgtcgatttttgtaaaatccccgccgcccaacagcgtatgaaccttcaatacgggaacaggcaggtcttttttgatcggcactgtgctgaccacaaaatcaatcgactcaaaggaaagctggtcaaggctgcagtaatcagccgttccgacgattttaagacgttttgcgaaccgggatcggagcttttctcttaaaagctgcgcgctgccggcgccggacgcacagacaatcagacagcgtttaggcggccgttccgtctttctcctttcaatcgcggctccgaaatgaagcgccaaatacccgatctcattttcatgaatatcaatgccggtttgctccttgattacgattcccgcaatcactcccgcttcaaatgcgagcggataattttcctttatggcggagagcatcgggtttctcaggttcattccgtaccggtttcggttaatcgccggcttgatatggagcgcaagacccgctttcagctcattgtcgtccgtgattccgagcttcagctcccgctcaatggcttcaatcatggcctccgtcaaacggctggtttccccgtctatcagccttgtaagctcttttccttccatttgtgactgggtcatgcgctttgtcccgagcaggtgaatggcgatataggctgtttcctgttcgggaaaggtgaccgaaagtgccgattcaagctcttttacgatggcttccgctgactgatattctgtttcgagcttaatatcatgaagatcttccggaatgagagatacatagttttctgtccggattcgtttgcaggcaatggcgatatggatgatgagattgttcaggccgaagaaagaaagcgggatcttatggtttcgaacctgcttcataatggctgtgcggatcacatgaatgtcgtctttcggcagaataccggccttttcactcaggagatcaggctcgggctcgcggtcgtccactaagtattccgccatacaataacggaggcggagctcttcgccgcgcagcttaaagccgtagttcggccttgtttccaaaatgatgtcataggggcggagccgttttttgacttcttttaaatcagattgaagtgtggatttactgatgaacagttcttccgctaagtcatccagcttgaggtagccgtcggccagaagcattcttttcatcaggtaatctatccgttcatcgggaaaaatcggcacggtgctgttctgctggaaattgtcctgaagccagtttttaaacggctgctcattccggatcagcagcttatagccgctccctctgacagattgaatggatgcgccgtgtttttctacaatggtttgcagttcctttatgtcattgcggaccgtccgcgtcgttacctttacatttgcagcgatgactgagcttgtaaccggtgtttcagcagctaaaagcaagcgcagaagttcacgaagccgcccatgaagcatgagaaaaacctcctatcagatcagatgcagacgtgaaaaatgggcaaaaagaatgaggaaggggtaaatgtatgtaaattctatactggggaggatttcaagtcaatgcggcaatccgatgccaagaccgtaaaaaaacagccggatcagccggctgttcgggatgcggacatgcggttccgcttagatgccttccgttcttttatgatttttctgatgatcggatagatgacgggcgcccatttgataatcgttttgaaaaattttttcaatgtctgaatcccctttcttttaccttgtctttcccctgttatcagcgtttataaacatggtcagcgtgagacataccggttccccgtcacccaatagcgccacggataatcccgggcttctccgctgttgtcaatcccgattctcgggcctgttgatatatgttcaggcgtaaagccctccgtaatatacagcggcggttccgtgatcatgccgccgtagtcgttcattgaaatgcccatcgccttcgtcagttttcccgggccgtttgtccactctctcgggggtctgcccggtctcctgctctccatcaggaactgtccttcatgaggctccgccgccctgattaacacggcctgcggaatgccgatgtccgcggcgacgacgttcattaatgtatgagtgtgcatgacgtatgtataaatgcggcccgcctcatggaacataatttccgtccgtttcgtgcgccggttgccgaagctgtgcgccgcccggtcatccgctcccatataagcttccgtttccacgataaaacctgaagccgttccctcatccgtctccttcaccaggagacagccgagcaataaaggggcaagctccactgacggtctctggtaaaattcaatcggcaaaggctttccttctcccgccatttgcctccctcctttctgaatatagcgatttcctctttcacgtttttcacttcttttttacaatataaacatgaaagaaaaaagggcatcattgttgaacactctattgcgttttgaaaatcggcccggtataatatgatggttcaaatgaaaatgattctcatattcaataaataccggacaatgatcataaaagtaggtgaattgatttttgagcgattctgtcacgtccgcaagccgtctgatcagcatcttaaaaaacggggttttcttcctgatcgcggtgatcgggctgcttgtttctatttttttcgccgtctcattcggcgcgaaagacattactttacatacggtttggtcggctgttgctgattacaatccgaacatgacgggccagcagatcattcatgaattgcgtcttccgagggtgctcggcgcggccgttacaggagccgcttttgccgcagccggcgccctcatgcagggtgtcacgagaaacccgcttgccgattcgggtgtcttaggcgtaaatgcgggcgccatgtttgttgttgcgctcagctttgcttttttccctcatttgtcatacgccctgctgatggtgatgtcatttttgggagcactggcaagcaccggcttgattttctttatcagtgcggcgggaaaaggcagcatgacacctttaaaggtgacgcttgccggggcggtcgtggccgcgcttttacattcactcagtaccggtgtggcgatttattacgatttaagccaggatttggccttctggtacgccggcggggtgtcggggatcaagtgggctcatttacaagtccttgttcccgtgattgcggtcttcatcattctcgcgacattcatgggccggtccgtcacccttctctcaatgggaaatgacgtggcggcgaatttaggggtgaacacggctctgacgcgtgccgcgggattaatgatcgccgtcgttcttgccggtgtgtctgtttccgctgccggcgcgatcggctttgtcgggctggtcattcctcatatcgcccgcaagatcgtcggcgttacgtacaggctgattattccgatgtccgcgttgctcggcgcgattcttttgattttggccgacttggcctcacgcacggtcagtcccccgagagaattggcgataggcatcatggtcgcacttgtcggtgtccctttctttctttatattgcccgcaaggaagggagagacttataaatgaaagtgcagaaagaaacaaaaaaagcggcggcggcaggtctcgttctgctggtcatcgccgtttgcattattctgatcgggctgcatacgggctcattccggctttctcccctcaccgtgggaaaaacgctgttcggttacggcacgtttcaaagcacaaccgttttattcgattaccggctcccccggatactggtgacgatgctggccggtatcggcttaggcgtgtcgggcgctgttttgcagggtgtatcccgaaatccgcttgccgatccgggcattctcggactgcatgccggcgcttccttcggtttgatgatgtatatcacattctttcattccctggaggcgcaggcgtcgatgttcatcccgctgtttacgtttgcgggcggaacactcgccgccctgctgatcgtagtgcttacgtacgacaggctgaacggttttttaacgatccgcatgctgttggtcgggatcgccgtttccgcgggcttcagcgccgttacattgtttatgtcgctgcgcctgaatgaagaaacttatacattcgcttcccgctggctggtgggaaacgtctggggcagagattggattcacgtgtggtcgctattgccctggatcggcattctcgcaccgcttgcatggcttaacgcccgttctttgaatattttaatgctcggtgaccaggcagccgcggggctcggcgcacacgtgcagagaaaaaggatcatgctgatcgccatagcggtcggcttgtcctgcgcgagcgtcgcgatggccggcggaatcggctttatcggctttgccgcccctcacttggcaagacggctcgtcggcaccatgcatcagcatattattccgattgcgggattaatcggccttgtcattcttgtcgcggcagacaccatcggccggtctttgtttcagccgaacgccattccggccggcgtggttgcggcagccatcggcgcgccgtattttctctatctcgtcatgaaaatcaaatcataaaacaaggagtattcccatgaaaaaaacaattgcgctcatcagtttcatgtgtattttcttactggctgcctgccaatccgattcatcacagccggagtcaaaaaagaaatccggcgatcataaaatcgcttcgatgtccattcacctgacaaatgatctgctggctctcggcgttacacctgccggttccgtcgtgggcggagaattaaaagattttctccctcatgtgaaaaatcagctgaaagacacgaaaaaactcggacctgcctcagacccggatatggaagctttacttgagctgaatccagacaacatttatcttgataaagaatttgcgggaaaagatgtgtcaaaatacaagaaaatcggaaacacacacgttttcgaccttgataaaggcacatggcgcgatcatttaaaagacatcggaaaaatcgtcaaccgtgaaaaagaagcgaaaacatttattcaagattatgaagatgaaacaaaacaagtcagatccatgatgaataaggaattagggaaaaacgccaaagtcatggcgatccgcgtgaacgcaaaagagcttcgcgtcttcagcacacgccgcccgatgggaccgattctgtttgacgatctgaagctgaaaccggctgacggcattaaagaaatgaacacctcccgcccttatgaagtcatttctcaagaagtgctgcctgattacaacgcggatgcgattttcgtggtcgttaacagagacgacaagtcacagcaagcctataaagaattgcaaaaaagcgctgtgtggaaagggctgaaggccgtgaaagcaaaccatgtctataaaattgccgatcagccttggcttgattattcggcactgggaaataaattagcaatggatgaagcgaaaaaactgttccaaaaataaacatgagccggttttgcaaaaagtgcaagaccggcttttttatattaccgtttacttatataaacattcgcttatataatagtttaaaaaaggagtgagcgcatggaacggcggcataatgctttaagttccgaagggatcagccagtgcctcaaacttctaagcgacccgacgaggcttttgatgctgaagcttctggaggataaggaatattgtgtctgcgagctgacggctatttttcatataagtcagcccggcatcagccagcacttgcggaaattaaagaacgccggccttgtgcgggaaagacgcgagggccaatggcggtactatgccattcatccgtccggaccggaatacgcgctggtttgctcgattctgcagcagatagatgaaaaggacgaagttttacagacattgcggcaaaaagaagtcactgttacatgccggtaagggggatatattcttgggagttgcggttttatcagcgctgatttttgtgctgacacttgtgtttgtcatatggcagccgaaacatatatcaatcggctggtctgcctgcggcggagcggtcctcgctttgatcgccggagcagtcagcctgcacgatatcgcggaagtgacggggatcgtctggaatgcgacactcgcctttatcgccattattatcatttcattaattcttgacagtatcggtttttttgagtgggccgcgctgcatatggccatggcggccaaaggcagcgggctgcggatgtttctctatgtgtcggtcttaggggctgtggtctccgccctgtttgccaatgacggagcggcgctcattttgacgccgatcgtactggcgatggtgcgggctttgaatttacctgaaaagctggtttttccgtttattatcgcgggaggattcatcgccgacaccacctcgctgccgctcgttgtaagcaatttggtcaatatcgtatccgccgattactttcatatcggatacattgaatatgcatcacgcatgctggtgcccaacctcttttctttggcggcaagcattttggtgctgtatctctatttcagaaaaaacattccgaaacggtttgacaccagccttgtgaaacatcctgcatccgccattaaggatgagcgccttttccggttatcatgggctgtcctggccgttttattgatcgggtatttcgtcagcgcgctgctgtcgatacccgtttccttcgttgccggctccatcgcggtcatttttctcattctggcgcagcgaagccccgccgtccctgcgaaacaagtcatcaaggacgccccgtgggccatcgtgtttttttctgtcggcatgtatgttgtcgtgtacggcttgcggaatgccggactgacggatcttctttctcagcttattcagaaagcggcggatcacggattgtttgcgggcacactcggaatgggttttatcgctgcgatcctctcctccgttatgaataacctgccgacggtgatgattgacgccatagccatcagcggaacggacactcacgggctgatgagagaagcattgatttacgcgaatgttatcggttctgacctcgggccgaaaatcacgccgatcgggtcgctggcgacattgttatggctccacgtgctgagccggaaaaacgtgaaaatttcctggggaatgtatttcaaaacaggtctgatattaaccattccgacgttattcatcaccctgatcggactttatatatggctgttatggctcgcttgagaaaaaaaccttttaagttgaatcttaaaaggtttttttgtgtcaaaaatccgaaaagttaaacttttatattttaaaagtatagacatttaatttcaaaagattataatattcatgaaaacgttttaactttatgaaagaagggattcctcatgaaaagaattttattagcctgcagctcaggcatgtccaccagccttcttgtcacgaaaatgcagaattacgccagctccatcggtgaggaggccgagatttgggcagtcggacaggataaagcaaaagaagcgatgaaagacgcagacgtcgtactgatcggcccgcagatgagttttttaaaaggcgagcttcaaaaagaggcggacccgcttcacatcaccgttgatgtgattgatatgatggcatacggcatgggagacggcaaaaaagcatacgaacaggccgttgccttgatagagaacaaataaaggaggcgataagcatggaaacgtacacggatgaacagatcagttttcagctgattcttcacagcggcaatgcccgcagctgtattattcaatcgatacgcgcttataaagacggccggccagatgagtcagacacctttctgacaaaggctgaagaagaactgggaaaagcgcacgacatccattttcagatgattcaaaaagaagccggcggcgccaaaacggatgtctctctgctttttatgcatgctgaagatcacttaatgtcagcgctttcaatgaaagagctcgtcaaagaaatgctcgacttatttcaatcaaaaaatttataaaaagccgggggtgaagacgtgtttgagaaaatcagccaattccttgttccgatcgcgggcaaattaaacaataaccgctatttgcaagttttacgggatgcttttatgctggcgtttccgctgaccattttcggttcggtgttcgtcgtgctgacgaacctgccgtttttaaacaaaatcatgagcagctccgccctgtctgtctttcaatccggatttggcggcgcttcgacggctacgatggggattatgtccatttttgtcgtcttcgggatcggctattacctttccaaaagctacgaagtggaggccgtattcggcggagcgatcgcattggtttcttttctgctgctcacccctttcgtcttagagccggaaacgggcaaagcggtcgcaggcgtcattccggttgaccggcttggagcaaaagggatgtttctaggcatgataaccgcttttttgtcaggtgaaatctacagaagaatcgtccagagaaacttaacgattaagatgcctgccggtgttcctccggctgttgctaaatcgttcgccgcattgataccggcttttatcacgcttaccgtcttcctcttgatcaatgcggctgtcacccagatctttcacaccaatctgcatgatgtcatttatcatacggttcaagccccgcttgtcggacttggaagcggcatcattcctacattaatcgctgttttctttattcagattttatggtttttcggacttcacggacagatcattatcaattccgtgatggacccgatctggaatacattacaggtcgaaaatttggctgcgtatacagcgggaaaagagattccccatattatttctaagccgtttatggagatttacaccgtcggaatgggcggaaccggaatgacattggccatagtgatcaccatcttgctttttatgaaaagcaaacagatgaaacagatatccaaactcggtctcgcgccaggtattttcaacgtcaatgagccggttattttcggtttgccgatcgtgatgaacccgatcattatcattccgtgggtaatcgcgccgatggttgtcacgctcgtcacctatctggccatgtcggcggggatcgtgccccctcctaccggcgtgaccgtgccctggaccgtcccccttttcattaacgggattatggcgaccaattccgtcatgggcggcattatgcagctggtcaacctctgtattgtctttgtcatctggttcccgtttcttaaagcgctggacaaattaaatatggcaaaggaaaaagaagccgaggccgagcagcatgcacgggatgacagcatgagtatgtaatcaaaatcgcagtaagggagagaaatcaattgactgaatcaaatattcaatatcgttttccggaaggattctggtgggggtcttccgcctccgccacccaaacagaaggcgccgccgacagagacggaaaaagccaaaacatatgggattactggtatgaaaaagagccgagccgtttttttaacggcgtcggccccggcgacacgtcacgtttttatgatcaatacaaggaggatatccggctgatgaaagaaatcggccacaactccttccggctgtctatttcctggtcaagattgattccggacggaactgacgaggtcaatcagaaagcggtcgcgttttatcaggacgtcatcgatgaaatgcttgcccatcgcattgagccgtttgtcaatttgtttcactttgacatgccgctcgcccttcagcgtaagggaggctgggtcagccgggacaccgttgacgcgtttgaacattacgccaaaacctgcttttcgctattcggtgacaaagtgaaaaaatggttcactcacaacgagccgattgtgccgattgaaggcggctacttatacgactttcactatccgaatcacgttaattttcaagaagcggtgcaggccggcttccataccctgctgtcgaatgcaagggctgtcaaagcctacagagaattgaaacaggacggacaaatcggaatcattctgaatctgacgccttcttatccgagaagctcacaccctgaagatctgaaagcatcccggattgccgacgcctttttcaaccgctcatttttagatcccgccgtaaagggcgaatttcctgaggagcttgtcgagattctcaaggcggaaggctttctgccgcgttatgagaaagaagatctccgcctcattcaggagcatacggttgacctgttaggcgtgaactactaccagccgagacgcgtcaaggcaaaagaacatgttccgaatccgcatgcccctttcctgcctgagcgtttcttcgatccgtacgtcatgcccggacggaaaatgaaccctcaccgcgggtgggaaatttacgaaaaaggaatctatgacattctcaccaatctcagagaacattacggaaatatcgaatgttttatttccgagaacggcatgggagttgaaggcgaggaacgcttccgcgatgaaaacggcatcattcaggatgattacaggattgaatttatccaggaacatctcaaatgggtgcatcgggccatcggagaaggttcaaatgttaaaggctatcatctttggactttcatggacaactggtcttggacaaatgcttataaaaaccgctatggctttgtatctgtcaatctggaaaacgggggcgaacggaccgtcaaaaaaagcggccgctggttcaaagccgtttccgatcaaaacggattttaacagatgaggaggtacggccatgcttggaggtattgaagccggcggcacgaaatttgtctgtgccgccggacaaaaagacggcaccattctggacagagcggagtttccgacgggagaaccggatgacacactcagacaggtcatccgttactttaaagatttcccgatagaagccatcggcatcgggtcgttcggaccgattgacatccgccccgacagtcaaacatacgggtgcatcaccgcgacgccgaagacagcctggcggaactgccctattcttcaaacaatcaaaaacgcactgcatattcccgcaggcttcaccaccgacgttaatgcggcggcgctcggagaagcttctttcggcgcggccaaaaacgcggacagctgcctctatttgacggtcggcactggcatcggagcgggcgccatcatgaacggcagatttgttcaagggctgtctcatcctgaaatgggccacatttatgtcagaagacaccctgacgacggctacaaaggcaattgcccttaccatacagattgcctggaaggcctcgcggcaggtcccgccattgagaaacgctgggggaaaaaagcatatctgctggcggatcagcaggaagtgtgggagcttgagggctattatattgccgaagcgcttgtgcagtatattctcatactttcgcctgaaaagatcattctcggcgggggcgtcatgaagcagcatcagctgttctcttatatccgtcagcacgtgaaaaagcggctgaatcaatatattgacctgcccgacattgaacacttcatcgttccccctcaattagggattcactccggcgcggccggttcgctcgtattggcggagcgcgcattagagacggcaaaccgggaggcgggaaaatgacgaaactcttatttttggaaccggtttttaaagaaagattatggggcgggacgaagctgcgcgatacattcgggtatgagattccttctgagcggacgggagagtgctgggcgatttcagctcatccgcacggtacatccatcgtgcggaacgggcctttttccggaacatcattacaccggctctggaatgaacaccctgacctgttcggacatccgaaagaagacgcttttcccctgctcacaaaaattcttgacgcaaatatggacttatccgtgcaggttcatccggatgacgcatatgcacatcggcatgaaaacggagaactcggaaaatcggaatgctggtacgtgttggactgcaaaaaagacgcggagctcattttagggcaccgcgcccaaacaaaagaagatttcgttcggctcattgaacgaaacgagtgggatcacctgctccgccgcatccccattaagcccggcgactttttctatgtcccgagcggcacactgcacgctttatgtgaaggtacgctcgttcttgaaatccagcaaagctctgatgccacctaccggctttacgactatgaccggacggatgggaacgggaataaacgcgagcttcatcttgagaaagcaattgacgtaacagacattccccataccgatgaaaatgtaaaaagcacaaagcatcggatcggagatgctcttattacgatactcgccgaaacacctttcttttcagtttatcaatgggatgtgagcgggaaagcatcattccccgcacccggccggtatttactcgcaagcgtgattaaaggacgcggagaactggatggatgccccattcacaaaggcgatcactttatcgtgccggcggattccggagattttgttatagaaggagattgtgaggttatcgtttcacacccttcatcatcttaaaaatcaggaggtcttttatatgcttaaaaagttagcagtctgcctgtctatcgttttattactcttaggagccgccagtccgatatcggctcacaccgtttatcccgtcaacccaaatgcccagcagacgacaaaagatatcatgaactggctggcgcacctgcccaaccgttcagaaaacagggtcatgtccggagcgttcggcggctacagcgatgtcactttttcaatgacagaggaaaaccgcttgaaaaacgcgacgggacagtctcccgccatctacggctgtgactatgggagagggtggctggaaacagcggatatcaccgatactatcgattacagctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaattgccgacggccttactcagctgaaaaatcaaggcgtcaccgttctgttcagaccgctgcatgaaatgaacggcgagtggttctggtgggggctgacaggctacaaccaaaaagacaatgagagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccacgtactttttgacatgggatgaacaattaagtccggcggccaatcaaggcgcgcaaagcctttatcaaaacagctggacgctgaacaagggcgaaatatggaacggcgggtccttgacgccgatcgcggaataaccgcttcttttgaaaatcggttttaaaaaacggctctgctgggcatattgttaccgttcaaaaaggagggttcaacaatggaaaataacaaaaacagcgaagaaacgctttccagtaagacgaccggtaaaggcgagtcagaagacacgctgacaaaccggcagggccatccggtcactgacaaccagaatgtcaggacagtcggcaatagaggaccgacgacattggagaattatgattttttggagaaaatcagccactttgaccgcgaacggattcccgagcgcgtcgttcacgcgcgcggcgccggcgcacacggatactttgaggcgtacggaagttttggagacgaggagatttctaaatatacaagagcgaaagtgtttcaaaagaaaggaacgaaaactccggcgtttgtgcggttttctaccgtcaaccacgggaagcattccccggaaacattgcgtgatccccggggttttgccgttaagctttataccgaagacggcaactgggatctggtcggcaacaacctgaaaatcttttttatccgtgatccgctgaagttcccggatcttgtgcacgcatttcagcctgatcccgttacgaacattcaggacggcgagcgtattttcgacttcatttcccaatcaccggaagcgactcatatgatcactttcttgttttcgccgtggggcatcccggccaactaccggcagatgcagggctcaggcgtccatgcctacaaatgggtcaatgaagaaggaaaagccgtgctcgtcaaatatcactttgaaccgaaacaaggcatccgcaacctgacacagaaggaagcggaagagattcaggggaaaaactttaaccatgcgacacaggatttgtatgaagcgattgaaaaaggcgattatcctgaatgggaagtgtatgcgcaaatcatgactgatgacgagcaccccgagctggattttgatccgcttgatccgaccaagctgtggtataaagacgatttcccttggaagccgatcggtaaattggttctgaacaaaaacccggaaaactaccatgccgaggtggaacaagcatcattcggaacgggcgtgcttgtggacggccttgatttttcagatgacaaattacttcaggggcggacattcgcctattcagatacccagcggtaccgcgtcggcgcaaattacctgcagcttccgatcaactcgccgaaaaagcatgtcgccaccaaccaggaaggcgggcaaatgcagtatcgtgtcgatcgggcagaaggacaaaacccgcacgtcaactatgagccgtccattatgggaggactcaccgaagctaagcaggatgggaaagaccatacacctcatgtcgaaggcgatgtgaagcgggaagcgatcgaccggccgaataacttcggccaggccggagaaacataccgcagattttcggaatttgaacggaacgaattgatcacaaacctggtcaatacgctttcttcctgccggaaagacattcaggatcaaatgattgagaatttcacaaaagcagatccggactacggaaaacgtgttgcggaagggctgaaaaaagcctccgaaagcaacagcggcgggccgatcggcactactgatacggcacaagccgcaaaacaggctgaacaggaaagccatccgtctgatccgtattaactaaaaaaacaggacaatcgcgtcctgtttttttttgagctaattcaactcctgtatattctgctccgccgcggccgcaaatactttcggctccggacgttcaagatcttcatggaataaacttactttgtgaatctgccggttgtcgtacagatgaaagtagtagtttccggtgtcacagcacatgaccgacgtatactgcgtataatcaatttcattctcctctgtgatcaccgcgccttttggaatattcacattggacagcacgtgaaaagcggccgtaacgccatccgtttcatgggcggaaggctctaaatgctctttcagataagcggctctgatgaaccgggatggcggcgtgtaatcaccgggaagcccgatcgttccagatccttggccgaaagcggttaatgtcattccgcccaatgttttgctttctgactgctgcggcctgattccgatataatggcgcagattggtcacatgccaaggaaattccggactgttggtcatcactccgggtttgttgtcatatactttcattccctccggtgtcggctcgatgacaatgcagctgcccgtgcggtctgataaaatccaatgaagaggcagcaccgtatccaataacattaacttcttctctacaatcgtcagcattgagagcttttcctttatgtcttcaagagagtcacagtttgataaggcccaggtgacaaactcatgaggagcgatgtgacaggtgccctcccgttccgctttctcgtatcccgcaaagcccggaaaatacagcgtcgcacacgacagccctttttcatttacgccgtcggcaaacagaacattgccgagatttctccccatgccgataaatgcgtatttcgtcttatgcatcctgccgtcagcttcgcttttccagctgtactgacgagggtaaagcacgacgtccgtaccgagctgaaatgcaaaatccatcgttcgcgccaataggtgattaccgtctgtcgttttcaatgtaagacttgtacacatatcatcaatccccttttcattaatgaaatttacacaaagtaaactattctttcagcttaacgaataatggttccattcgtcaaaagattgacacatttctccttcatacatattagtcagtaagcgtatccatgccttttaaaccctggcaaatcgttttggcggcagtgtttgtaccgtttttcaaaaaaaactttgaacggctgtcagcgaggctttacaatgtttttcctgcatgctggaatttgtaaacggcaggtcaatctgttaagctatgtctttatgttaaagaagaacatacggaggagattatctattgaaagtagaaaggcgaacgattgaacatattccgcatgacgaaagacacggaaaggctaaagatttattccccgtctggttcggggctaatatgcatattacgacgttagtcacaggcacactgcccgttacaatgggactcgatctcttttggagtatcgccgccattataatcggaacctttatcggcgcaatctttatggcgtctcattccgcacaaggacctcagctcggaattccgcaaatgattcaaagccgcgcgcaattcggcgtgatcggagcgattctgcccctctttttggtcatgtttatttacctgggcttctttgcgagcagtacgattctcgcagccggtacactgagcagctttgtcccgattccggcttcatggtgtattatcggcttaagcgccatctgttttttactcacgatctacggtcatgatctgattcacaaaatgcagaaaatcctctcttggacctcctttgccgttttttttgctgcaacaattcttatttttcaactgccgattccttcaggaagctgggtgcccggctcattagatctgcctgtttttctagtggcggtcagcgcggtggccacatggcagctggcatacgcgccatatgtcgcagattattcccgttatctgccggtcaaaacaccggcatcgcatactttttggtacagctacgcaggtacgtcagtcagttccatatggatgatgcttctcggcgccattttgacgacggcgctcccggaatttaccgctaatgcgggaaatgagattgtccgattgttcggtccgttttcctttattatgctgatcatcgtcctgttcgggcaaatggcgatcaacgtctttaatttatacggagcctttatgtcaaccacgactaccttggagccgtttttaaaactgaaggtgacgccgaaaacgagagtggtaatgatcctttgtgtgacggcagcgggtactgtattaagtctcttgggccaaagcaatttcatggaactgtttttaaatttcatctttttcatcagttatttcttaattccatggacggcgatcaacctcgtggattattattttatccgccgcggaaaataccacgtcaaatcgatgtttgacgtcaacgggcaatacggcagggtcaattggattacagcggccgccttcgttttgtcgattatattagaaatcccgttcatcaatacctccttttacatcgggccgctcgctgaaatattcggcggaggcgacattgcctgggtcatcggcctggccgttccgtcgctgctgtattatgtcctgatgaaatcaaggttaaaacaaaaagaggcgccttccctgtgaagacgccttttctttattcatattccttccatacacgcggcagcagttcagaaagttcgtgcgccaataaggtatgggcggagcgctctttcgtccataattccgcacattcgccgtgaaggcggacggcgttcaatacggcatgcttcgggtcttgatgacagcacagcatgccgagaatcattcccgtcagcgtgtcgccggtcccgccttttgcaagcgcgccgtttccggttgtattcctgcggcattccccgtcgggaaaagcgataatggtttcgtttcctttcaggacaatcgtgacctgaagccgctccgcccattccgcggcatattccgccctgttctgctgaatctcttgaatcggaaggcctgtcattctggaaaattcgccgggatgaggcgtcaagatcacgggagctttcctctttgaataggttcttttcgtaattgcgcccgcgtccagtatgacgggataatcgccagaaagcagctgatcagccgcctgctgcacttcgtctgtttggggaaggcccggcccgatggcagcggcccggatggtttccccgggctggcccgccgcggcttttttccacccgtcccgccagtacgtggcttccggcagcaccgggacgataagcggaatgacgcctgccgatgtaccgatgacgagcttgccgacaccgcttctcatcgcacccaatccggccagaagggcggctcccggcatgtcatcgctcccggccagcaataacgccgtcccgaacgttcctttatggctgtccgcctcccgtttcggcagcgtatctttcacatcctgttccgtccaatccattatattcatctctgtacctcctcttctgtctcctatttatattccaaacaagaagagattttaaaccgcacaaaaaaacagccgctcgtttgcggctgtttatgttctgatcggaacatcaagacggtaaagcttccggtacctttcgttttctgcaagcagctcttgatgggttccttccatttctgcttttccattttctaaaaagacgattttatcagctgtttccacacccgctaaatggtgtgtaatccagaggatcgttttctctttaaaaacatcaaaaatcgtatcaagcaattcacgttcagtgaccgcatcaaggccgaccgtcggttcatcaaggataatgaccggcgtgtcttggagcagaatacgggcaagcgcgatccgctgccgttccccgcctgaaaaacgaatccccgtctcctgcacggacgtttcatatccgtcaggcagtgattcaatataatcatggagcttcacttgccgagccgcacgcttaacatcttcatcactcgccttgccgtttccgagccggatattgttcataatgctcgtgttaaagagatgaggtttctgattcaaaacggccaccgctgaggaaatctgctcctgcacggccgcagtttccagcccgttcagcatcaccttgcccgaatcgggaactaaggcgccttcaattaaagcgagagaggtcgacttaccggagccgctcctgccgagcagcgccattttttccccctggcggagagtgaaggaaaaacggtcaagcacatgactgtgctgatcataagaaaacgtcacgttatcaaatgtaagtgtcacatcagatacatccagtttctcatcggtctgcttcacctcatgacttcgcagctccggagccgccttactcattcttttgatggaatcctgataagaaggcacttccgtcagcgcatccgaaaggggcagaaacgcctccgtcaatggaaatacgacaagcacaaaggccgcgatcatcgtgttggcgatgctgccgtccgcatactgacccgccgtccagaacagcatgatcaatatgaagccgccgacgaggcattgcgcggcgagatcacgccatctcgtaaaccgctgacgtttgctttcaaggtcaaaccatgccttctctttctcttcataagaggaaataaaggccgcctgtcgtcccgagaacatccagtcgctcacgccgagcacggcatctgtcagccggctgtagagcgtattccggccgcttttcagcctcatgtttttcgctctcgtcacaagaagcgacacaaccggaaacaatacaaccaatataaacaggtaaatcgccgcaaaagcggcaaacggccaggaaaaaaaaccgagtccgataacggatgccgcatacagcagcaaagcggaaaccgccgggaaaatcgtttttaaaaacgcatcctgcaaatgctcaatatcctcagccaaaatgccgagcatgtcgcccgtccgaaaacgggatgaaagcatgagcgaggccggctccagcatattgtaaagccgcaccctcatgtcggacacgattttcaaaatgatatggtgtcccgtcagacgctcggcgtaccgtgagactgaacgggcaatcccgaacgtccgcacggccacaatcggaacgtacaccagcaggatattctcaggccttgtcgccgacttagagatcaaaaaaccggaagtgaacatgagaaaggccgccgaaaaaatcgtcaccgcgcctaaaaaaatcacaagaacaaacaaacgggcattttgcttcatatacggcagaatccattcttcttttctcatgttctttcccccagttgcgcctttacaagtttggcgtatacgccttgtttcgccatcaattcgtcgtgggtgccgatttccgccaccgcgccgtcatcaagcacgataatttcatccatctcaagcatccaatgaagacggtgagtggccagaaagacaagtttgttttcaaacaggtctttcatcgtttcttttatttcatattctgtttcaatatcaaggtgagcggtcggctcatccaaaaggagaatcggccggtttcctaaaaaggctctggccagcgcgacacgctgagcctgccctccgctgagcgcccgtccgccctcgccgatccggccgtcaagaccgccgggcagatcgcggatcagtccggaaagacccgctgaatcagcggcgcgcgccgtttcctcacgggaagcatcaggatgataaaaccggatattattcataagcgtgtcatcaaaaatgtacggatgctgcggaatatagagcagctgcttctgccagccgtccgactgcagatgcgagcgggattcaccgtttaccttgatctcaccggacgcaggctctaaaaagcctcccagcacatcaatgagtgtcgattttcccgcaccgctttccccgataatcccgattttcttcttccctttaaaggacagatgaaattcagacatcgattctcggacggacaaacgcgtaagctgtaattcatccccgtcagtccacgtatcaagttcgagcggcttttcttctttaaaaccgggctgcgccaaaatcgcttgaatggttttccccgcctcctgcccgtttaacgtcgcgtggtaatcatttcccacttcgcggaccgggagaaaatattcaggcgcgagaatcagcgcggtcaatgccggaccgagcagaatttgtccgtctatcagccgcaagccgagaaacaccgccactgtcgccaccgacagcatcgtaaagaaatccagggcgaatgatgataaaaacgcgacccggagcgtgctcatcgtcgccttgcggtatctctcactgacatgaaagatgtttttactgtgtgatttgcttaatcctaaaaaccgcaatgtctccagtccgcggagcgaatccacgaaatgattggaaagcgtctgataggacttccattggcgatcggcttttttctgtgcgacaagtccgagcagaatcataaatacaatcaaaatcggaagcgcaagaatcagaatcaaagccgatgttttatcctgaaaaaacacgtaaataacaacggccgccggcacaatcgccatgctgaccattttcggcagaaacagctctaaataacggcggaactggctgatgccttccatcgccagcgtcaccatccggcctgtcccctcttttttcgcaaagcgggggccgagacggaacaattgctcaagaaatctttttcttaagtctgcgccggtttgcgcggcatattggtatacgattttctgccggaccgctgtcaccgcatgccggaccaaaaacgcaagcaggaaaaagccgataaccggataaagagaagcaatccgcttcccgttaaataatccggttaccgcctggctcagccattccgcctgcaagatgatggcggccgtttgtataatcgttaatcccgtaatgatcgcaagaatccgcttcattcctttataaagaaacaggtcttttcccattaataagtcataggctccttatggctgacgcgtttccggaagacataatagctccagatctgactgccgatgacaaacggcagcagagtcagtgcggcaattgtcatgactttaagtgaataatcaccggatgacgcgttagctactgttaagtcatacgcgcttttcagcgagctgaccatgacgcgcgggaacagagagataaaaatcatcgcaactgtcaaagcaagacccgcgccggtcataccgaatgcccagccgtcttttttcttgctcatgaacacaacagcaagaacgttgcagatgacaatcagcacgaataccggaatcgtgatgtttgcccggcgtgtaaacatatccgtatcgtatgcagacattgcaaagaaagcaagtacaacaagaaagataacaccgattacgcgttttgccatttttctcgcacgctcttgtaaatcaccgatcgtgcgcagtgtgacaaacattaaaccgtgcaggaatgaaagaagggtgacggctgctccgccaaggacggaatacacgttcacaatatctgagaaacccgcatgcatattcatatggccgtcaatcggcatgccgcggaacaagcttgtgaagataaggccgaatacaaacggcgggataaggctgccgaagaaaatcacccagtcccatgttttgacccattttaaatgattcacttttccgcggaattcaaacgccaccccgcggcccattaaagcaagaaggatgatgataaacggaatataatatccgctcagcatcgtcgcataccagttcgggaatgccgcgaagatcgctcccgtacctgtcagcagccatacctcattcgcatcccagaacgggccgatggtgttaatcagcactctgcgttctaattcattatggccaagaaatcgggtcgaaatgccgacaccgaaatcaaaaccttctaaaaagaaaaatccgacaaacaaaactgaaacgagtacaaaccaaagatcatgaagtgaccccatggtagacctcctgactgaacggatccgttgatacaggaacatccttgtgatcatcatggtccgcaccttttttaatttcacgaacgaataggaagacaagcagcgcgcctaaaatcaagtacatgacgccgaaaccgataattgaaaacagcagagatcccgtcgttacgttaggcgaaacggattgtgcggttgtcatttgccccataaccgtccacggctggcggccgatttcagtcataatccaaccggcagagttcgcaatgaacgggaatgcgatcagtgcgatcatgccccgtaaataccacttgctcgtatgaagctttttgcggcggttcagaataaagcctgcaatcgcggcaaaaatcataagcgcgcccgctcccgccataatgcggaaactccagaacgtcgttttgacaggcgggatatagtcgccttttccgtacgttttttcatattctttttgaagtgttttcatccctttcacactgccgctgaacttctggtaagccaagtagctgagtgcgtaaggaattgaaatttctgatgtgtttttttctttattcgtatcaatattcgcaaaagccgtccacgcggcaggatcaccgctgtcatcccaaagcgcttcactggcggccattttcatcggctgcgactccattaaatgctcagcctgcatgtgtccgctgaacgcaacaccgataccggcgatcagaccgacaatcatcgaaagcttgaaagatttatggaagaaaggcacttcttttttcttcaataatttaaatgcgctgacaccggcgataaagaaagcacccgtcgcaagcgctccgaaaatgacgtgagggaattcaacccaaagctgagggtttgtcaaaagcgctccgaagtcattcatttccgcgcggccgtttttaatcgtaaagcctaccggctcctgcatgaatgagtttgccgtcaaaatccagaaagatgacataatcgttccgaaggatacaagccaaatgcaaagcaaatgcacttttttagataaacggtcccagccgaaaatccataatccgataaaaatagactccataaaaaatgccaaaagcgcttcaatcgcaagcggagccccaaatacgtccccgacaaaacgggaataatcagaccagttcaatccgaactggaattcctgaagaatccctgtgacgacgccgacagcaaagttaattaaaaagagatgcccccaaaatttagccattttgagataggtctcttgttttttgacaacataaagcgtctccatcaaagcaaccataaacacaagcccgatagacataggcacaaacaagaagtgaaacaatgttgtagatgcaaattgaatgcgggctaataccaactcactcatgatgtttttcctccaatctggtaaattgctcaacatttcacaaacatagcggaatcattgctcggtatttcacaaaaaatgatatatttgctcaatgtttcacaaattcgtcaaaactattgaaatatcagcctgtacaccctgggggtcagcggctgtcatagaaatgattcaatatcattactttacaacgattcagcccaaaaaaaaagatcaatatacctaaaatcaggctgaaattgtgactgattattgtcggatttgtagagattttatgtcagcacctaggatatttgtccctttgatatcgtacctcttttttattcgtgtggcgaacaaaatgcttttctcggtgaaaaagcccgcaaaatcgccattttgagaaagaaaatgtgaagaaagcatggcctctagtaaattcataatatatgaacaatttaaattttttagtatactttaaatggggatattttttcactacataacgactgggggaacaagcatgggagaacttcaaccaaaattgcaaacggattcaatccaaaaacaggaacggactgataactggtttgccagagcaatgaatataagaatcggcattattcctcttcctatctatatcctgcttttcttgcttattacggtgtttgtcatgagccgtgatgtaaaaagcgacattctgacatcaattgccgtcatgagttttttcggatttaccttcggccagatcggaaaatccattccgatcgtgcggtccatcggcggccctgcgattctcgcaacctttattccatccgctgtcgtctactaccacctgcttccgaaagacattattacttcaacaacagaattcacggaaagctccaactttctctatctatttattgccggtatcgtcgtcggcagtattctcgggatgaaaagagagacgctcgtcaaagctttcgttaagatttttattccgctgatcgccggctcgatcgcggccgccatcgtcggcttatgcgtcgggacgctgctcgggctcggctttcagcacacgctgctttatatcgtcgttccgattatggcggggggtgtcggtgaaggcgcgattcctttatccatcggctactccgatattatgccgatgtcccagggagacgcctttgcgcttgtgctgccgtccatcatgctaggcagcctgtgcgccattatgttatcgggtttgctgaatgtcatcgggaaacgcaaaccggaatggacgggcaacgggaaggttgataagtctgatcattccgctcccgcattggaacagccggccgatgataaaacgtttgatttgtcctttttcgcttcaggcggtattttagcggtttccctctatttggtcggcatgctggcgcatgatttctttcagcttccggctcctgtcgtgatgctcgtccttgccgttctcattaagctgttcaggctggcgccggcttcgattgaaaacggagccttcggcgtctcgcgctttttctcgacagccgtgacctatccgctcttatttgcgatcggcgtttcaatgacaccgtgggacaagctgattgcggcgtttacgatcagcaacatcattaccattttatcaatcgtcgtcacgatgatggccgtcggttttctgaccggaaaatggctgaatctgtacccgattgagacggcggttattaatgcctgccattccggccagggcggcaccggcgacgtcgcgatcttgagcgccgctgaacggcttgagcttatgccgttcgcccaagtgtcgaccagaatcggcggagcgattaccgtgagcgtcacccttctgctgcttcatcaattctattaaactgaaaaaaagcctccgcatatgcggaggctttgttatttcatcacattttgaatataagagccgaatgccgcgccggacatgcccggcgacacacggacgcggtgaagcccgtaaagcccctgatctctagacgccgctcccggctccgtcgtgaccgccatacggtagcctgacgaggcggcggcttttaatgtttctttattatatcgtccgacagggtagctgatcatagtcgtccgctgcccgaacacttgatcaaataaacgcttagagtccttcatttcacgtcgctgctgctgcggtgtgagcccgttcaattcgagatggttcatcgtatggctctgaatggaaatgccgtgggcggccatctccttcatctgcttctcagtcagatgattcttatggccgataaagtttccgatcataaagattgtcgctttcatcttgtatttctttaaaatgggataggccgctttcacattgtcggtatagccgtcatcaaatgtgatcagaacacatttttcacgcggctccttatcctccgtcagcatcagataggcttcttcaggagtcatcgtataatagccgtgatcatgaagccacttcatatgctgccggaattcttccttcggcacacgcaggctgtttccctctgaaatgctgtgatacatcagaatcggcagtctcgccgtccctttcgtttgaacccaggcggacgtatccggctcttttttgatttgccgctttacggactttttttcgctgtgcgcttctgccttcggaatgctttgttcggcgcttgcctcatggcccgagcaggcggcaagcgtaaacacggcagccaaaaggcacatgcacatgatcatgcgtttcatcgttttcctgctttctgtcttctatttactttttatatcggttatgcgtcataaattgttacatcaaaaaagccggacatccagctgtccggctttgcgttatgagcggattctgatttctgtttcactgtcaaaaaagtgagccttattcatgtcgaaagcgacagtcaattcctcaccggcacgaatgtcatggcgggcgtcaatccgggcgataaaatcctgatccccgatccgggaataaaccataatttctgacccgagcaattccgcgacattgattttagctgtgatggatgaattcttataggattctaccacaatcagctcgtcatgtatgtcttccgggcggatgccgaagaccacatctttgccggcataccctttttcccggagcattttcattttcccttccggcacgctgagagcggctgaaccgatctgaatggcgccgtccgtcagctttcctttgaaaaagttcatcgccggggagccgatgaacccgccgacaaatacgttttcgggatgttcatacacttctttcggggtgccgatctgctgaatttttccgtccttcatgactacgatgcgtgtcgccatcgtcagtgcttctgtttggtcgtgcgtcacatagattgtggttgtttgcagcctttgatggagcttaataatttcagcccgcatctgcacccgaagctttgcgtccagatttgacagcggctcatccattaagaacactttggcgtccctgacaatcgcccgtcctaatgcaacccgctgccgctgcccgccggagagcgccttcggtttgcggtgcagatactctgtgagccccagcattttcgccgcttcttcgacccgttttttaatctccggtttcggcatcttcctcagcttcagaccgaaagcgatattatcatagaccgtcatgtgcggatataacgcatagttttgaaacaccatggcgatatccctgtctttaggagcgatgtcattcactctcgtgtcaccgatatagaaatcgcccttcgtaatgtcttccagcccggctaccatccgcaaagttgtcgacttgccgcaccccgacggaccgacaaacacgataaactctttatctttaatatgaaggttaaaatcatcgacagccgcttctttttgatcgtaatacttataaatatgctcgagccgaagttccgccatgtatatccccctttatttgtaaacgctttcttaaataggattgtaacagcgtcagacggcggcggatataggcaatgttcataaaaaaagtccgctgccttcgtgcacatttcccatttaatgtgatttttcatattgcagacaaatgaaataagccagcagggcgccccgatatgtcttaatatcaatacctgagcgttccgcaaatttatcaatccgatattgaagactgttgcggtgcaaatgcagttttttcgatgtgagcgacatgttcgagttatgttcaataaaagtctgaatcgtatgcttcagctccggttctttctgaaacagcagcgccgcttcttcgtgaagcaaggctgagagcttttctctgctttcctccgtgagcatggccggaaataccgtttccgcggtcagcgtgctcagctgcgggagatgacgccggccgatctgacaatattgctgttctctctgataatgaaggcgcagacgttcccccttgcagtaataccttccgacgaaaaaacggacactgaaataaaaatcgccttcgagaatcttcacaaaagatgcgatgtcatccgaatctggcgcttcccgcttttcttcctccacaatcacgccatgatccctccccgtccggacaactgtatatgaaaccggccagaaatggcgcagcgcttctgtgaatgccccccagtcccgttctcccaataagtcataatggataaaacggacacgcggctccttgacatcaggcaccggaccttcttccagcagaaaacgccgccacctctttgctgccgccgtctccggaaaaaaaacgcctttttcttcagcgggcgtcaaaaatgattccagaagcagtttctccttcggggtgatatcctccttcggaatggcgacatagacccgccttttctcatcataaaagcaaaagacatcgtccgccgtacagcacgtatcagacaacacagccctcgggtaaattgccaataacgggttcatatgcgctcctttctatcgctctatcatattttcagtataaaacgtccggccgattgtatccacttcgttttaagaaacagctttcaggctatttcccgggaaacgaatcataaccgcttctgccggcataagaaaaaaccctccgcgccggcagagggatccttttttatttagagatatcgacgaagccttcaccaaagacgtcacgcacatcatgaacaatgacaaacgcttttgtatcacagcttttaatgatttttttgagcatggaaagctcttgtttctggatgacgatatataaaatttccttcgactgccccgtgtaatttcctttacccgacagcagcgtaacccctctgtccatcagcgtgttgacctgttcggcgatttcgtgcttatgctcagatataatcgtcaccgcttttttcgtattcaggccttcaatgataaagtccatcaccttcgttccgatgtacagcataacaatggtaaacatcattttttccgcaccgatgatgaaataagaactgaagacgacaatcagatcaaagaacaaaagcgcatagctgatattccaatcgagatatttgttcgcaatcctcgccaaaatggcagaacccgcagtcgtgcctccgactcgaataatgatcccgattccgacaccggcaaacacacccgcaaaaatagtattaataatgagttcatgtgaaggcgagtgccaatcatgcgtcagatgcagaaacagtgagttggcgacaacggtaatgatcgtataaagcgttgtttttccgtctaaaaatttatatccgatcatcaataagatcccattcaaaatgatattcgtcaccccgggcgaccattcaaacacatagtacaagatcagggtgattcccgttaccccgccctctccaagatcattcggaatggcgaataaattaacggccaaagcaaagataaaagctccaataatcagcatcagcacatccagcaatctctttttcatcccagacactcccttttttataaaatcaaaaaagcccgggagagcactcttcattaaaagagcagaaactcccgggcttttatcccaacgtgtcacagcaggaacctgctgtgtgttttctctcggtccagaccaattcagattgcggaaccctagaaaaccactgttttttatgttcagtttttatattatctttcaagattatacgggaaatcacgaacatgttcaaccactcttttttcaataaacctgtaaaaaattcgaacgatctgccgatactaaaaaaggcactaaaatacatgactaaaaaattattaaaatactttttttctcaaaatattattgactataggttattttacaggcattatagtatgtagtttttaagaaatagtttacataggaggaaatattatggcaggcaacctggtgtcttgtaaggcatgcggcaaagaaatcgctaaaggcgttaaaaaatgcccaaactgcggtaaagatcagagaaactttttcatgagacataaaatcatcacattgcttctggcagtggtggttattatcattctcgtaaacatcggcggcggaggcgattcttcatcatctaaaactgcgtcttcaaaagctgcggaatctaaagaaaaactgtataacatcggtgacactgttaagactgagaaaactgaagttactgttaccaaagtggaaaaaagggattcagtaggctctcaatttgtcgagaaaaaagcgtctgacggcggcgttatcgtagctgttcaatacacggttaaaaatgtttcaaacaagccgttaagctctttctccattccaagagcgaaattagtagattctaaaggaacatcttatgattcagatattgatgcttcttcaagctatgcaacagaaacaaaagtagacaatagtaaaattttaagtgacttgaacccgaacattaaagtgactgacgtaaaagcttttgaagttgataaagacgcatactctaaaggcacttggaaattaaagttcagcaacgatgttgaagtgaaaattaaataatcatcataacaaaagagaccttcatcattcgaaggtctctttctttttacgccttttggtacccgttcacattggaggactgccacttccaagagtcggcgcacatttcttcaagcccgcgctttgcttcccagcctaattcagccttcgcttttgccgggtctgcgaagcatgcggcgatgtctcccgggcgccggtctgcaaaacggtacggcacttcttttcccgatactttttcaaacgccttgaccatctccagaacgctgtagcctcttcccgtgccgagattataggcgtcggcgcccgttgtgttcagcaccttttcgagcgctctgacatggccctcggcaaggtcaacgacatggatgtaatcccgcacgccggtgccatcctttgtcggataatcattgccgaacacctgcaatcgctcaagcttgccgacagcgacttgtgcgacgtacggcattaaattattcgggatgccgttcgggtcttctccgatccggccgctcgggtgcgcgccgaacggattaaagtagcggagcagcgcaatgctccattcagagtccgcattatgcagatcgcgtaaaatctgttccagcatcagctttgtctgcccgtaaggattggtggcgcttaaaggaaaatcctcagtgatcggcgttgtttccggaacgccgtaaaccgtcgctgaagaactgaagacgatttttttcacgccgtgtgcctgcatggcttcacataaaataaacgttcccgtcagattattatgataataacggagcggaacagccacagactcaccgacggcttttaatcccgcaaaatgaatgacggcttcaatctcattttcagcaaacacccggtgaacggcgtcacggtcaaggagatccgcttcataaaacacaagcccttttccggtaatgtctttcacacgctccaatgcttccggtgaactgtttgacagattatccagaaccacgatgtcatagccgccgtttaacagctcgacacatgtgtggctgccgatataacccgctccgcctgtcactaaaatcgccatgaagaaagcctcccctattgaatgaattgaccatattatatcggttttttcttcctcaatcatccatttccaaaaagtttaatcgtttagtcatcgtttcttcataatttattttcattcgcgtaaaaaacagagccctcgattcaaacgggttgtgaaatagaaatccctcccccgcgcatggtaagataagacaaaggagatgacggtatgaaaaatgaaatcattgaacgctttacctcttacgtaaaagtcgatacacagtctgacgaaaacaatgaaaactgcccttcaacacccggccagctgacattggccaacatgctggcagatgaattaaagtcggtcggcatgacagaaatcacagtcgatgacaacgggtacgtcatggcgactctgccggcgaatacggataaagacgtgccgactgtcggttttctggctcacgtggacaccgcgaccgattttaccggaaaaaatgtgaatcctcagattattgaaagctacgacgggcatgatatcgttctgaatgacaaactcaatgtcgtcctgtcgcctgagcaattcccggaactttcccgctataagggccagacgctgattacaacagacggcacgacgctgctcggagccgacaacaaagcgggcattgccgaaatcatgacggcaatggcgtacttgatcaaacatccggacatcaaacacggaacgatccgggtcgcgttcacgcccgatgaagaaatcggcagaggccctcacaaattcgatgtcggccgcttcaacgccgcattcgcctacacgatagacggaggccccctcggcgaactgcaatatgaaagctttaacgcagccgccgcaaagcttacttgttacggaaaaagcgtccacccggggacggcgaaaaacaaaatggtcaacgcttcaaaaatcgcgatggaatttcatcacgcgctgccgaaagaagaagcgccggaatatacggaagggtatgaaggcttctatcatttactttccatggacggagacgtttctgaagccgccctgtcgtacatcatcagagactttgacagagaccgctttgcagaacgaaaagaatatatgcagaaaaccgccgatgcgctagcggccaaatacggcaaggaaagcatcaagcttgaactgcgtgatcaatattacaacatgagagaaaaaatcgaaccggtcaaagagatagtcgatgtcgcgtatcaagccatgaaaaacctcgacatcgaaccgattatcgaaccgatccggggcggaaccgacggctcacagctctcttacatgggactgccgacaccgaacattttcacgggcggccaaaacttccacggaaaatatgaatacatttccgtcgatcatatggaaaaggcggtaaacgtcattgttgaaatcgccaggctctttgaagagcgcgcttaaaaccaaagccccctgctttggtttttttctttcacatgaaacctttccttctttctttccgtatataaggtatgaaatggaaagaaggagtgaagactatggcaagagggactgtagcgaaagaattgaaaaaaaccttaaaagacccgcgtgttctggagacgaaatcaaatccttttaaaaaactgcggaaaatgttcaaacgatttttttaagataacatctcgttttcgttaaaaaaataaagaaagcgctgtcaactcgcagtcatctgttagaagcagttattttgcatatcatacggttttttagggtactgaataacacaaggcaaacgaaaacaccgaagtagttaattaggcacttacaaaaaatagtgaaaaagttatataaacgatcattattcatcagccgatacaatctatagaaccacaacaagagcaaaatttcttcaacccatagtcatttttacggaaaatgacgttattttttaaaaaagtgacaattgtttgaatacttttcgtttgttttttcgtacaataataataccaaaactttttttgggaggtatgtaaaatgatgctacttattttcgctgctttgacagggtatcttgttttctctttcagtaaggacaaccgccggaaaacgccaaagacaagcccgctggtgacagctgccgacacgaataacatcattgatttaaatgcgatccgtcaaaaacgtcggatgccgctatcataaaaacgacagctgccgcaaaatcggcagcctttttttatgcacccggccgatatgaaaccttccgcctccttttttcgtacaacataaaaaaggagtttttttatgtaccatttttacatcaaagagcgaatgtttacgattaagaatcgttttcaagtgtttcttgaaagcggaaaagaagtctacaatgttgaaggaaagctgttttcattcggtgatgaactgaagctgactgatttggacggccgcacgctcgccagcgtcaatcagaaactgatgtcgctcgttccccgttacgagatttccgtcagcggcaaacccgtctgccaagtcatcaagaaagtcacgtttttcaaaccgaaatttgaaatttccggactcggctgggatcttaccggcgatgtgtggggccggaattttcaagtgacagacggaaaatcaaaccggatgaccgtcaccaaatcatggatgagctggggcgattcctatcatttgcagattgaaaaggaagaggatattgctctttgtcttgcgatcgccatcgtgatagatatgattctatttgagggtgacaaataaaaatatttatcgaaatatattgacaatataagataatatactaagattaagagtattacagtttattctgaaaaatagcatatttccttatcaagagaggtggagggactggccctatgatacccggcaaccgctgttcagcagaatggtgctaaatcctgaagataaggttgagatttgcggacgcaagctcttccctatccgagggaagagtttttttatatttcatcaggaaagaaggaatcgttcatgtcacagcaaaacacagaacaaccattgcatactcttctaagaaaaaacccgccgtttcgcgcggatcaggtcggaagcctgctgcggccggcggctgtgaagcaagcccgcctgcaaagagcggcaggtgagatttcagcagaacagctgcgcgaaatcgaaaacagagaaatcatccgcagcgtggaaaagcagaaagaaaccggcctcaatgtcgtgactgacggcgaattccgccgtgcctggtggcattttgattttctcgaaaatttagacggggttgaggcatttacgcctgaaagcggcattcagtttcacaacgtacagacgaaagcgcgcggcattaaagtaacgggagatattgatttttctcagcatccgatgctcgaagattataaattcctgcacagcattgccggcgatgctgttccgaaaatgaccatcccaagtccgaatatgctgtttttccgcggaaaattggaaaaagcggcctaccagaatgattacaaacaatttcagcacgatgtgtcaaaagcgtataaaaaagcgattcaagctttctatgacgccgggtgccgctaccttcagcttgatgacaccgcatgggccgttttcttatcggaagcggggcttcgccagattgaagcattcggaacgacgccggatgagctgcgcaggctgtttgccgcttccattaatgacgcgatcaaggagcgccctgacgatctgaaggttacgatgcatatctgccgcggcaacttccaatccacatggacggctgaaggcggatatgatgcggcggcggaaacgatttttgacgggcttaaccttgacggattgttcttggaatatgatgattcccgctccggcggctttgaaccgctccgctatgtcaaacgctctgatcttcagcttgtgcttggattgattacatcaaaacatggcgaacttgaagacaaggacgcgattaaacgccggattgaagaagcttcacaatatgtcagcctggatcagctttgcctcagcccgcaatgcggattcgcctccactgaggaaggaaacctgatcacagaagaacagcaatgggcgaaactgcgtcatgtcgtcaacattgccggtgaagtctggaaataaaaaaaagacacgcgatcagcgtgtcttttctgtttacagaggaccggttccgattaaaatatcgatatctatcgtaatatccgccgcttttcggctgataaaccgccggatgctttcatcagtacatttccatgttaagggcgtcattttcacaagccgctcgaggtcaggctgcgataaggtcttcgtgtaacacagccgtttgcgctcaaaggtttgaaagcccgcttggaatcttccggccgcagaatcggcggtgtcattccgccgaggactgtctccgaagaagaattcccttacttccttcaaataatcacgccgcggcaccgctttaatgactgtgccgccctttcgtaaaagcctgctgcattccttgtaattccaaggtgataaaacagacatcacgacatcaaaacagctgtcggcaaacggcgcatccgccacatcagcgacggcaaaaacaaaatgatccccgaaggcctttgcggcatgcagcacaccttctttcgagagatcaatgccgattcccgtcacggaaaaagcgggctgaagccatttgcatacggcggctaaatgagagccttctccgcatcccgcatccaatatcgccgccgttgtttgcggagattgaatgcggctgatgatggcggcgatctccttttgaaccggcccaaaaaattcccggctgtcaaaaagagcgcgtctcgcttcgaacagctgcctgtcatagcgggttttgaccgatttattgagaaaattcacatatccttgctttgatatatcaaatgtatgcccgtgtccgcacatcaagcttttgtattgtgagacctccatggccgaactgcatagcggacacctgaatacggactggcatgattgcagtaattccgcgcgttttctttttatagacgtcaataaaaacacctcattcattcgttattccgatgaaatgaaaaaggcatagacaaataaacctcgcaaaattggaagtttaacctatttatctatacctctcattatctgtaacgaatgaactgaatgatcatgaaaatgaccccttctctgccgtcttttgaaggcggtgccctcagatccattttatcagctgcatcccgtctttacaatgaaccggaactgtttttcgggggctttttatacctttttaatccaattacttgtgaacatcctttattttctttatttataatataaatttattattttgaaaatatctaaaaaggttgattttcaaaaattgaaacgataaaatactgctatctcatgtaatatcgttattcttgtatatgatcagtaatatggtctgattgtttctacctagtgccgtaaaagactagactacaagaaagtttgcataaatttgaacgagtgaaaagcatatgatgctgtcagtctattcttttcttttggctcttatttatcacactttctggctttcaggaatttgtgacgaataagagctttttttatttccataatacccttataggagttgctcacatgtactttttattgaacattgtcggtctcattgttgtcatggctgttgttttcttatgctctcccaacaagaagaagattaaatggcgtccgattgtcatgctcctcgtctttgagtttctgattacttggtttatgttagggacaaaagtcggcggctttgtcatcgggaagatcggcgcgttctttacatggctgatttcctgcgccagtcaagggattgcgttcgcctttccgtctgtcatggcgaacccgacggttgattttttcttcagcgcattgctgccgattatcttcgtcgtgaccttctttgatatgctgtcgtatttcggtattctgccgtggctcattgataaaatcggctggctgatttctaaaatatcccgtctgccgaagctggagagctttttctccatccagatgatgtttttaggaaatacggaagctttagccgtcatccgccagcagcttgccgccgtcagcaacaatcggcttctgacattcgggctgatgagcatgagcagcatcagcggttcgatcatcggatcgtacttgacgatggttccgtccacttatgtgtttacagccatcccgctgaattgcttaaacgcgcttttaatcgccaatatgctgaatcccgtggacgtttctaaagaggatgatattatttacgttccttcaaaagcggagaaaaaagacttcttctccacgatttctaacagtatgcttgtcggcatgaacatggtcattgttattttagcgatggtaatcggatatgtggcgttaacggctgcgttaaacggcgtactcggactgttcatgcacggtttgaccattcaaaagattttctcatacatcttcagtccgtttgccttccttctcggattaggcgtacatgacgcgatgtatgtcgcacagctgatgggcatcaagctcgcgacgaatgaatttgtggcaatggccgatctgaaagggcagctgaaatcacttccgccgcacacgattgccgtggctacgacattcctgacatcattcgcaaacttcagcaccatcggtatgatctacggatcttatcaatctctgcttgatggtgaaaaatcagccatcatcgggaaaaacgtctggaagctgcttgtcagcggaattgccgtttccttattgagcgcggcgattgtcggattgtttgtctggtaaaagaaaaaaagcgataccgctccgttttggagtgatatcgcttttttttattgatagacggatgcaggcacgaaaacgccccggattcctgccgcgtacggtccgagatcatattgtccaaacacaacggcaataccgtttttcgtaaagaagaaaggtctttcgttattcaggatgatctcttgttttttgacgtcctggtcaaacagatcgttatgtttcttaatgtagccgtaaagatagtctctcgttttgttggctttcgtttttgtattcagcacatcattgagtgtgacctgtttttttgcggccaggtcgtaattaaaggtctgaacggctgtcagcccgtgtgctccgcctgtgtaactgtagttttccgtctgaatgctgagcttgccgtcttgattatacttcaccttgaaatctgcctggtattccgctttatagccttgtttttcaccgtcttttttgttttttacatattctttgtacgagttttcaatatagcgtttgaagtcctgattgattttcttttcaaaagatgcgtttcccgtatttgtgacctcggggtacgtcagctgctttacatacttatacgtctggcttttgacgacgggctttgcggtttgcgcggcctctgctgaaggcgcgaaacctccgaacggcgaggctgtcagcactgttaagagcacggccgccatcattttgaatgcttttttcatcacaactcctccttttcattaccgttccctttttgaaaacggattacactctatagacagcgcagatcagcaaattgtttctgggccttctttcacattttctccatgaaaaaaagagacatggataatccacgcctcttttaccgtgaaggtctttgcgcaatggcttcataaacggcttccgccaaatcggagttgccgaacatctccaaaacgccgatgacggtttgatcaggaatcggttctgattcctccttcggcacgacaagctcttcagccgtttttcgcagctcttcgtttaaaggctgtccggggtaagccttgctgtaaatggccatcggatcaaggtcatgattgacgcaccattgggcaaacaccaaaatcatcatgttttcgtcacgccggtaatattcttcgagttgtttttcggtaaacggcttcactatgtatccctctgcttttattaatcttctacttgaagttccaaagtttcaatctgctttcgaataatttgaatgtctctcttaattaatgtccccggtactataatttttgcagattttccattagtaagggaaaaatcgaacctttgcatttcaatagttccttgttctaacgcttctcttggagtgctgttttttttatccattaatgtttcctctctatttgattttattatttttttatttttatgtattatatttgcgaataaagctgactcaatgaaaatcctagaagcatattcactactgttatctgaaatttcatggtatacatttaaaatctcaggtaaattatctggaattgctccttcacttgaatacttattgaaaagttcagcaaatagttctggttgaagaaatgctgttctcaaagcactttgaaaatccttctcactcattgaatcaattatccttttggaaagttgagtcagcttataattaccagaggatctttctaataatccaaagtgttttaaggatgctattttgttgcctacagccccgctgtattttttatatcccagagcttttgttattaagtccttttcaatatcgctatctcctgaataacttcttattaacttagcaaactttaaagtattttctaaattaaatcgcggaaatccacggcttctctttttcataaaactctcctaacttgtatcgcgagataattactaactttaaacttatgttaactaaaagtcaacttcagttcaagtaatatagagattaaattttttgtttgttctattattaactcaactctcgttattctactctaataacttaaaaagtgcctcattttcagaggcactcaaatatattcttatatgtttctgtcccaatgccgatgctcagccacggctttcagaaattgttcatggtttccgtccggaacaagaccggggccgctttcggttccggcggcgagggcgagaagttcttttccttcaccggaggcgccgatcgctttgtaatggctgaaagcttcgttgacgaagtctctggccgatttttgggctttgaggctgtctgtgctttgttttccgcccggaatgaaaacagcgtcgtacaggacggaatccgctgtcaggaacgtggctgacgcttcgagctccgtgccgttttctcccttgacggttcccagcgcggggctgatgatatcggctctgactcccgcctgtttgcatgcgtcaagcacttgtttgactttctcatcagaaaacccgtggtcggttaaaaccgcaacctgccttgtcgctgccgtcttcaccgtgttttcctggcttaaggccggggaagtgaacgtttcatcagattcacggtccttcggcggcgggttcacgccgattcctttcgcaacacgctcggcaagcccggcgtcgacgtgactgaagacatcaaccacctgctgctgcacatccttgctgttcacttttccgacttcaaaacagaacgcggagatgatatgttctttctcggcgggagacatgctgttccagaacatcttggcctgagaaaaatagtcattgaagctctcgctgcgctggcggatttttctgccttctactttttcctggtaatgaacgtatccgccttcttcttctgaggccggcgacggatcattgttctgcagagaatttttatgataggcgacagggcccttattaatcgtcatccggtggtagccgtcgtattggttgttatggaacgggcagaccggccggttgatcggaatctcgtgaaaattcggcccgccaagacggatgagctgtgtatctgtataagagaaaagccggccttgaagaagcggatcattggtgaaatcaatgcccggcacgacatttcccgggtgaaaggcgacctgttccgtttccgcaaagacattgtcctgattgcggtcaagggtcatttttccgatcagcttgacgggaaccaactcctccggccacagcttcgtcggatcaaggatatcgaaatcaaatttaaattcatcttcttcgtcaatcatctgaacaccgagctcatactcgactttgccgccgttttcaatcgtttcccataggtcgcggcggttgaaatcgggatctttcccggcaattttctgcgcttcatcccatacgagggaatgaacgccgagcacgggtttccagtggaatttgacaaagcgcgcttttcctttctcgttgacgaaacggaacgtatgcacgccgaagccctccatcatccgatagcttcgcgggatgccgcggtcagacatcgtccacatgaccatgtgcgcggattcaggattgtttgcgacaaaatcccagaacgtatcatgagccgtcgcagcctgcggcatttcattgtgcggttccggttttatggcgtgaacgagatccgggaatttgatcgcgtcctgaatgaagaacaccggaatattgtttccgacgaggtcatagttcccttcttcagtataaaacttcgtcgcaaatcccctggcgtcacggacggtgtcggctgaccccttggagcccgccactgttgagaaacggacgaaaacaggcgttttgacggacgggtcctgcaaaaatttcgcccgtgtatattccgtcatcggttcgtacacctgaaaatgcccatgaacgccgtacccgcgcgcatgaacgacccgttccggaatccgctcgtgatcaaagtgcgtcattttttcacgaaaatgaaaatcctccatcagcgtggggccgcggacgcccgcttttaaggaatgctcatcctcagacacgcgaagcccctgattggtcgtcatttttttgccgctgttatcagatcggtactgctccagctgttcgtcctttgagtgttcatttactcgtttgttttgatcatcactcatgtcagttcccccttctaaaacgaaacattctacagcacatttacccgcggcgttcttcaaataaactgctgatccgctcattaggattttaggtctgtatttacatatgcggtcatacacattttgaaataagcccttttcacagaaacaaaatgtgaaaacgcttaccaaaacagctgttgaacaggggaggtcatatcgtgcttgccatactcggttttgtgatgatgattgtctttatgtatcttattatgtctaaccggctttccgctcttattgctttgattgtcgttcctgttgtgtttgccctgatcagcggatttggcaaagatctcggcgggatgatgattcagggcgttacagacctcgctcctaccgggatcatgctgttattcgccatcctttatttcggcattatgattgactcaggtctgtttgatcccctcattgccaaaatcctatcgcttgtcaaaggggatccgttaaaaatcgccatcggcacagcggttctgacgatgaccatttcgctggacggagatgggacaacaacgtatatgattacgattgcggcaatgctgcccctttacaaacggctcggcatgaaccgtttggtgctggcggggattgcgatgctcggttcgggcgtcatgaatattattccgtggggcgggccgacggcgagggttttggcttccttgaaattggacacgtcagaagtttttacgcctctgattcccgctatgatcgccggcgttctctgggtgatcgccgttgcttatctcctcggaaaaaaagaacggaagcggctcggcatcatttcgattgaacacgcgccgtcttctgatccggaggcggcgccgctgaagcgtcccgctctccagtggtttaacctgctgctgactgtcgctctgatggccgcgctgatcaccagcctgcttcccatccctgttctttttatgatcgcgttcgccatcgccttgatggtcaactacccaaatgtcaaagagcagcagaaacggatttcggcgcatgcgggtaatgcgttaaacgttgtctcaatggtatttgcggcaggcatatttacaggcattctctcaggcacaaaaatggtcgatgcgatggcgcattctctcgtttccctcatccctgatgccatgggcccgcatctgccgttgatcacggcgattgccagcatgcctttcacctttttcatgtcgaatgacgccttttacttcggtgttcttcccatcatcgccgaagccgcttccgcttacggaatagacgccgctgaaatcggaagagcctccttgctgggacagccggtgcatctgctcagcccgcttgtgccatccacctatctattggtcggaatggcaggcgtcagctttggcgaccatcaaaaattcactattaaatgggccgtgggaacaacgattgtgatgacgattgcggcgcttttgattgggattatttcgttttaattaaaaaaggatttccgctggcggaaatccttttctgtacattatttttttgtatagcgcacccagtcataatgagcgtatagcggatttacaccattgtaggaaccgagccagtcatcgacacctatcccattccacaagttcatcatgatctttcccggtgttgtcgggatttggcttgtcgcagtatgttttaattgcccatcgacataccatttaatagagttcggctgccaatcgaacgcatacgtatgataggcattggccgcgtcaaatccgagatccgcaaccttctcatggtttcccgcgccatttgtataataattaaattgaacctttgtcgtgtcttttcctaaaaattcgatatcaatctcatcccaaggggtaccatccgttggacctgtataagtgaagaacgatgaaacgatccccgtgtttttagccggtttcattctgacttcataaagtccatagccataggtttgagcggagcggttctccccgcagtcaaacttgttataagacgggcttgtcagcgccaaacgcatttcacctgatgacgtcacggatacattatttgcccgccaagtgcagttgaacatatctccattggagtaaccatttgctttttgccagaaaccggagttatagctgttaaaaggttcaaaaaacgatccgcctgtttgagctgatgcagcagaagtgatcgcacacaaactcaaaaacaatccagtgacaagaatgagcagcactcgtttcatacgataaaacatgtcggcattcccctttctttgaaagcgatttctttatcgatcatacatgattctgttaaaagggaacatcggtcagaataatgataataacgaattttaaaaaaacctaaattaccatcagcacagtaagagatgatccgcactcattgtaatttaggttttgcctgcttatgagtaacaatcctaacaagatcatatatgaatgtaagaaaaaatgaatacaagaaaacaaaaatacaaacgctttcattatgcttgtttgactaccctttctatgtgaatcgttaaatacagcagctcgtcactggtgagcttgtgctcatacgccctctcaatgcatgtttggattttcttcgtgcattcatacgcccgatggtatttttctttcactgtctccagcaaaaagtcgtcctggctttccatatgtgtgccgttaaaaagacgctgcgcgaaaaactttaagtgggtgacaaatcgataatagtgaagcgattcttcgttgaattcaatcttaaaatggtattttacgatcctcaaaatctcttgcatgacttttgtaatgttgatgatattgggcatctcttcattcagctcggcatttacaatatgcagcgcaataaagccagcttcatcctccggcagagacacgccagtcttgtttttcaccatggccaacgcttgtttgccgattgcaaattcgtctttgtacagccgtttcgtttcccacagcaaggcgtttttgatatccagccctttcttattgcgctggatcgcaaagttaatatgatcggtcagcgacacatagatgctgtcgttgagctttttgccgagctgtaatttcgcatagctgataatctcctcggatacttccatacactcgatcggaatatcatacaaaagggttttgaacttttctgatacatctttgttatcgagggtgaacactttctcaatgcgggcttcatctaccggatctcccgttttcttttgaaaagcaatgccccggcccatgatgaccaattcctgattgccttctttgagcacactgacgacattattattaatgactttcgcaatcttcaattccgtctccctccagcctgaccatttacctgctacaccttgattgtacatcctttttgtactaggtcaatatctccaggtcaatcagaaaacgccgttcagaaatcattgtccaacgatgaggcagcggcgcatataatgcagagaaccggtttttgggaaggagcatgtgtgatgaaacggttttcgaaagaagaaagcagctggatgctgtatgattgggccaattcagcttattcggtcattattatgacggcggtgtttcccttgttttttaaagcggcggcggcggaaaacggcgtcagcgcggctgattccaccgcttatttgggctatacgattgccgccgcgacttttattttggcgatgctcagccccgtcttaggaacgattgccgactacaaaggatgcaagaaacggttttttgccttcttttttctgatcggtgtggcgggcaccgccgcgctggctttgattcccggcgaaccttggatgctgttattaatttgttatacgatttccacgatcggctttgccggatctaatgtgttttatgatgcgtttctcgttgatgtggccgcaaaggagcggatgaatatggtgtccgccagggggtttgggctgggctatatcggcagtacaatcccttttctcctcagcattgccgtgattctgtcagcacaagcggagatgattccgctgtccgcccaggctgccggccgcattgcctttttgattacggcggcatggtgggggctgttttcgattccgctccttctccgcgtccgccagcgctattatatcgagagggagccgcggcttgtgatcagcagttttatacggctggccggcacgctgaagcagatcaggaagcaccgggcgctgtttttgtttctgctcgcctatttcttctacatcgacggggtcggcaccatcattacgatgtccacgtcatacggggctgacctcggcatcagcgcggcaaatctgctgattgttttatttgtcactcaggtcgtcgccgcgcctttttcaattttgtacggacggctggccgaacggtttaagggaaaaacaatgctttatgccggcatcggcgtgtatatgattgtctgcacgtatgcttattttatggattccgcttttgatttctgggttttggctatgcttgtcgccacttcccaaggcggtattcaggcgctgagccgctcttactttgcaaagcttgtccccaaacagaacgccaatgagtttttcggcttttataatattttcggcaagttcgcttcaattatcggcccgcttttgattgccgtgaccgcccagctgaccggaaattcgtcagccgccgtgttcagcctgattttgttatttgtgatcggcattgccatccttgcgtttgtgcctgaggaaacggcgtaaaaaaagcctgcacgcggcaggctttctttttttatttcttggctttatggactttcagttttttgcctttgaccgtcgtatttttcatgatgtcaagaacgtgcgggcctttgccgttcagaatttcgacgtacgatgcgttgtccagaatcgtgataatcccgatatcatcggctgaaacgccgtcgattttcgcgatcgtccctacaaaatcgaccgctctgagttttttctttttcccgccgttaaaatacagtttcatgatgtctttgtttaactgttcgcttttgtctgttttgacatcggggcgggcgttcaatttttccgcaaatgccgctttccgttccgctgtttctttttccgacggcgcttcccgcttttggatgcggaaaccgatatatgtctcaatgtcattcagaaaccgcgattcagacggcgtcacaaacgtaacggccagtccgcggtgtccggcgcggcccgttctgcctgtgcggtgcacatagctttctttttcaagcggaatatcataattgatgacgaggctgatgttttcgatatcaattcctctggcggcaacgtcggtcgcaatgagatagcggaactcgccgcgcttgaattcattcatgacgtcaaagcggtcttcctgcaccatgccgccgtgaattttatcgcaagggtagcccagcctgtccagctcatcggttaactgtatgactctttcttttgtccggcagaatatgatgcagctgtccgggttttcggtgatcaggacatcacgcagcaaagatgttttgtcctcttcttctgttctggtgacaaaatgctcaatgtcttttgtcgtcaggccttccgcttttacttcaatcaattcagggtctttcatatatgtgcggctcagcttctcgacgtcatccggcagcgtcgctgaaaacagcatggtgactctgtttttcggcagatgctgaatgatggcttccacctgttcaataaatcccatattcagcatttcatccgcttcgtcaatcaccacatacgccagccgctcaagcggcagcgtccctttttctatatgatcaagcacacgccccggtgttccggcaacgacgtggcttttttgcttcagttcggttttctgtttgtcaaaagaagcttttccgaaaaccgccgtggcttttatccgtttgaaacggccgatattcgtgatatcttctttaatctgcgccgcaagctcgcgggtcggcgttaaaatcagggcctgcggtttgttttcctcccactccgcaagctcgcagatcggaatgccgaaagccgcggttttgccgctgcccgtctgcgatttgacgacgaggtcttttttttgcagcgcggcggggatgacgcgccgctgcacttcagtcggctcggtgtattgcaagccattcagcgcccgtcggatctcggggctgatcgcatattcattaaactcattcatgactaaactccttctctgtccggctcccctcattatacgcgaaatgccgccgctttaccctgacgttttgccgggccgttcgggggactgctttttcttcatgtcgagcacgacccatttggcgcaataaaagcacatgcttccttccccgtcatcgacatagtagcggatcgattcccagccgctgttcgaccgggctgatatccagatggatgtcggtgatgctttcaagatcatccagccgggcagacctcacatcctcaaagcgcagcacggcatcatactgtccgtcagtcagcttcagctcaaacaccgggattttatcataatactcgttatacccggtatagaacgtaaactccgtcaattcaaaacaacccggcgaatccggccccagcagaactgctttctcatgtttgtgccactccattttgcgcctcctttttttcacctgaattgacatgtctgactcaaatgaattttttttacaaacccccatgaacttctttatattcctgcacccaatctcttaattcttctaacgtatgcagatacgcatcaggcgaatctttcagatcaagcccgctcaaatatacgagcatctcccaaacggtttcgtcctcaaccgccggatcatctgcagccacgtactcgcacgcccaatccgacacttcttccctcgccgcttgaccgttcaggatcagaccagccttcttcagacattctgctattgttggttctttcacgtcagaagcctgcctttcatttcttgtttaaaatgctgactaacagcctcctggcccgttcatgccgcccgatttcccggctgagctccggataatccgttaaagcgtttttcagctgcgcatattgcggatacagctcaaaaaaggatttatataaggctttacgctgccgcacagggatttgtttattcgccaacacaaaatctaagctgccgcagacaagtgcgaagtattcataaaaatccccagcgcaggcagcaccctcaaagtcttcttcgaatctccctgcatctgaaggcagcggcccctctaattcttttttgtataatttcaggtttcggatgacgtcatcatttaaagaatatctgatggattttaacatctcagaatcactcgaatatcacctgattcatcgatgatcgtaatcgaaagcccgccattctgatgccgtccgagatacagacgcccgcagttatcaaaatgacaaaaacatccttttactgattcttcgactatcttattcatttttattttcatataattaccccttgagtcttggatggtattttatttatatcgatcgttcactctgtaaaatgatatgcagatggctgaaaaaagccatctgcataggattgatcaatactttaccatatataaatcgttatcactaaagataaaaatgcggtcctggacggctctgtacgttgtttctccttttctatcaataccgtgtatcatgacgtcagcctctgataagcctttgttctcttcatgaaatgcaaataggttatcctcgtgactctgaatcagaagcaccctttttttcgaaacggatagctgatcacaataggagtattgatcgccgtccagcacatattctgcaacagtacgaattctgtcccgtccaatctgataatgcccgatgacacagcaatcctctccctcgaaacatacatacaaatcagatttgatcgattgtacggcatagcattcatgcatcatttctttaaaatcgtcttcaaaataaaacgttctgtcttctgcatgaaaagcaaatatcgctttcccttgagggtttctctcatcatacataccctcgtccgttaatccgatccataataatccatcctcacccagatgaaatacattggcgcttaatagaaaagaacaaatcggattgattttattactgtttatgcagtatgttgccaattgacacgtatgattttccagataaacgatcacgattgtgttatcatacgaatcaacgagatagaattgggcaacttcagaaaatccgtgtaactcttttttgattaaaagagagctgcctttcataacctccaatattactttgtgatcgtgcaccgacacaataaatacctgatcatcccgacccgcattgaaataaatgatgtgctctcttttatatgacccaacccgctccgcgataagttctaacatcagcaacactccatagattaagaatctggaatttatatcaaattaatcaatgatatataaatctgctgcatcaaattcaaaccaaatgattttttcattattttcagtagttacatcaaccttttgagtgttcaggttcatataggacttatttttggcaggatttgctattataacaaagtcattgatcgatgctaaaaaatataattcatctaataagtgatctgccatcaattcttctttggttagggcacattcaatatgaatgaactttttcgatacagtattcatatttatcattttcttttcaaccttcttcttccattcttcaataaaagaaggaaatgccattacttctattagagctgtttcgaattctaagtcattcattaattgagaaaaagtatctttactcactagatcacatgaataaatcgaattgtatttaagcggattaatcacatccagattccctatagccctcaatgattctttttgtaaatttaaaggagtgttcatgtttgcctccgcgaacgatttcgttatgtaagaaaagagaggctgggacctctcttatttgtttatttatgatttcgaatgatacgcataaaatgattggtcgtcaaagcgaactgtttcagcttctatagcaatcagcattctgttcatgtcaatgagaaaattagcatttgattgatactccggaattacagcatttgatagattaccgattccttccgggtggtaactcatctcaaatacttgccaattgtattcttcaggatctattttttctaatctcatatcaccaatatctgcactgaaataaacagatgctacattttgaaaaagaatgttatgcgtatattcggctttattttcaacgacctgaatcttaagtgaaagttcttttttaaacacttgaaaatcaaaatgaaggacagcgcaccccccacctatgtaatctacccattcatttattgttttgtacatcgtttatctccctaaagttttggagtctttgagatctgattttagagtctacacgaaaagttctagcttctcttcattacgaatattcgttttctttatctatactcaaaataaaaaatggttcaattgtttctaaacgtatcctgtcttgattgcctgctaataacgcttcgatcactgatgtcagcattttatattcactttctaataaacggcagagtaatcgcgggcgattactttattatgttccaacatttcaaacattgttgagataaaaggatcatcctccgcctcttgataccttcttggtgttatttcaagttccagacagctgtctccgattttggtcgctgtctcctccctttgagtgagagaggctgggaacctctcttcacattaatagactaggattcatttaacatttcaatcatttctgccgcttctaagtacaattcatttatcctgttttgaatttcttctgcgatttcttcatcactttctagatctgataaatatcccgctttacctgaaaacaactttttttcacaaacccatatatcaaaatgatctacacaatagccgtcttcattatcgtgaaagccggtgccgcccaaataggctgcaaaaaaaaatatcagtgaatgataggtattctcccgactcttccaaaagcagcttcaattttcaatcccatttttctaaacgtttcttgattgtttcataatttgtttaatgcgattcgttcaaaatgtttttctattcaggttgatgttttcatgttactctccggtattctggcggttagggtgagttaagttccacttcttgtgcaacacagttttaacaatagtaatattattgaaattgtttatcaatatttccctaggtatttaaggttattttaaggattataggaattttgaaccttttatccatataaaaaaaccgccggctgccggcggtttttcgtattatggatagcggagatttgtattttgcgctcccgcgtaggattgggcgaagtttttggcgtcctgggctgaaagcgtgccgtagctgtaatttgatctcggattccaaccggtgcgcggtgatttcggggctttgagcgacgggaatgaaccgatgtcggtgaattgggccgtcccgtaatcgtctatcattccgcctttttcatttccgttaccgaaatagttggcttctgagaagacagtcgcgtttgtatgaatggtgaatcctaaattaaaattggtcacatagttgttttttgcgtgaaaatagccgtatctcatcaggcccggtgaacgcacatagacgttattaaaatagttgttggtgatcgtcatatgcggatagccgatataattgcgtccttcgttatcatcattcgggtaaccgagaatcaggccgtacagatggtctgtgaatttagagttagacagcgtcacaaaatccgctttggcgccgacatacagaagctttcccaaatcgctgcggctgttcggattgtagctgtgtccttcaaaccacacgtggtcaatccagtaattctgcccgttcgctatgtacatcggaatgtcgttgttgcctgtaatggcggcattatggctgataatgagatttttgaaaatcacattgtttgatccggagcctgttgtcagatagatgttggtcagcctgtggctggtataagagccgacgatggttttattggcgccgactgtcacaacggctttacccggggaagaaatatcacttgtgatgacgatggttttgcggtccgttccgcccgcattgtttttcagatcattgagattgctgacgtagacgacggggccgccctggcctcccgatacggcggattttgcttttccgttatgatccttcgcattgccagcgaatccggtaagtccctgcatcacatccggataagccgctgccgcttctgcctgcttggatgcggaacatacgatggccagacaaagcgcaaagccgagtgcagccaagaaagcgagatgacgcgtcttctttttcatgcccttcactcctttaatctcttaaattgtaaacacatgaagtattatacaattactatcctctttttccatgatctgtttgtctgctttttcgttatggctgaaaagccccaaaataaaaaaagcagccggtacggccgcctatatacgggtgctgtctgcctgagtttccgccggcacagctttttgctttcgaatcaaggacagcgccattcccgcaaaaatcaacacaatccccaaagattgataaaggtcggggcgaaatcccgtaaatacggtgtcaagcacaatcgccaccgccggatcaagaaatacgatgattgaaataaaccgggtggataaaaaccgcaagctgtcaaaaaagagcaaatacacaattcccgtatgaatgataccggttgacacaatcatgatccagttcacatgcgacaaatcagaaaaagcgccgaaacggacgaacgggagaagaatgataacgcccaacccggtctgcaaacaggtgaccgcatatgggctgagactgttgatacctttcccggccagtgtcgtaaaggcgtaaaaaagggcggccagcacggcccaaataatacccgatcccatcagctgagaaaatgatgtacttccgttgatgccggaaatcagggcggtgcccagaaaacaaatcacgatggaagtgacggacacaatatgcagtttctcccggtatataaggctccctagaagaaggacgagaaccggagccagatgataaacggaaatcgctatcgtcactgatgtctcctcaaatgatttaaataaaaacacccagttcagcacgagaaaaaatccgcaggccagtgtctgcagcacctcacgccggttccattgttcggtgcggtaccgtccggaaccaaaccagcaaacgcccagaaacaatgaggcgcacagacatctcacaaagaccagttcaattgaaggcacattcgtatgttccgagaaaaagccgattgatccgaaaatgaccatggaaatgaccattttgatgacggcatttgatgtttgttcagcttgcattgattcgcttcccccatatcattgactgtttattcagacaaatactaacagccattttacttgattcagaggaagatttcatcctatttttcgaaagacggcggtcttttctcattaaaaaaagccccgcatcagcagggtcttctgtttaatgaacgatcagtacaggacaaggagacaattgtgagaccttatggctcacgcttccgagcatcatttctttaaatccgctgattccgcggcttccgacgacaatcagattgaaatgctgttctttcgctatgtttaaaatttgatgcgcaggttcaccttggacgtacaggctttccgcatttaccccgctttcagccgctttctgcttggcctcctccagaatggccgctcctttttgctcgacttcatgtttgatgtcttcaatgaagttttccggaacatagacaatccctgttaaggctgatgtggagacaacggcttcacgtcccgcatagagaatggtgagttcagcctgctgttctttcgccagatggatcgctgcgtccaaagctttgctgctcatgtctgaaccgtctactgctgcaagaatttttttaaacatatgaatcccgcctttctgcttttattgtcctcctctctttgctgaatgtcaattttgccggctttctccggaacattgcgcttacagactttctccgtttgtggcgatgacgtttttataccaaaccaaaccacctcagcgttattttttaagcgcttaataaataggactttattctcttctttttcagtattacctattggtaaaagtagtgataaaatggaattattgatataaaaaaggagattatgatgagaaatcatagaggcttccatgaggaaattcagcaacaacaaaaactttatccaacatcacatcgcattcaaccggtcagcccaaaagaatatgcagaggttttgactttacatacggcaaaacaactgagcgagacatttcaaacacttgtggatcaagatcaatatgaacaagcgattcagcttagcgagaaggtcgcctctcagcttggaaaacatacgaatttttcattgccactttccacagtgctttatagtttaaatgaaatggaacttcctatttcagaggaattttctctacatcgtctgaaactgctaggaaatcatcaaactcatgataactttttcaaagcattaaaacacgaaatgttaacggcggatcgggtagactttatggttagttttacaaggtggtctggtgttcagcttttgatccctccgcttcaggagcttgctaaaagacatgttcctgtacgcatcattacatctacctatatgggtattacagaaccgaaggcgttaagacatcttcttcaatttgaaaatgtagagttgagaattgtaaatgaatataaaaaatctttccatacgaaagcatacttatttgaacgctgttctggacagcatagtgtcattgtaggatcttcaaatctatcacaagctgcccttacgaccgggtatgagttaaatgtgagactacctgaaaccagatatctccccgtttatcaacaaacaaaagatttgtttgacactgtttggaatgaaaagacacagcctgttgacgaacaatttttacaagcctatgaggaattccaagctggaagccaaaaggtaagtgcttcctttgctgctcaaaactctctttacaaaacgaaaatgtccccgaattccatgcaaaaggaagcattacgaaaccttaaaaaaacaagaaacgaaggggagacaaaagcagtcatcatcgccgccactggaaccggaaaaacatttttagcagcatttgattttgagcaatttaaaccaaataaatatctttttcttgcccaccgggaagagttactttcaaaagcaatcgaaacattcaagaaagtcacaaataatcatgaagattttggcttattgactggcacgaaaaaagaaagagataagcgttttttatttagcactgtacaaacgttacataaaaaagatactttggaatctttttcaacagatgagtttgactacattgtgattgatgaattccatcatgcagaagcatctacctatcaagctgtattaaactactttacaccaaagtttttattaggtttaaccgcaacaccagagcgtcttgacggtaaagatgtgcttcagatttgtgatcataatgttgtttatgaaattagactccgcgatgccctaaaggcagagctacttgcgccatttcactattttggaatttcagatcatactgtagattacgaaaaagtaaaagtgaaaaatggactgtacgaagagaaatcgctagtcgatcatttaaaaacgcataaacgagtagaatatatcatcaagatgatcaacatgtatggattccacggcgagaaaatggttggcttaggtttctgtacaaacgtcgaacacgcaatatacatgagtgatgaatttaataaattgggtttttatacaacttatttaacaggaaatgattctcctgcaaaaagacaagaggtcattcgtcaattggaggatccgcaccacagtttagaacttatatttacagtagatattttcaacgaaggaatagatattccaaagctcaatctactattgttccttagaccaacagaatcaccaacgattttcattcagcaattaggacggggacttagaaaaactgacgacaaagagtttgtaacgatactggattttatcggaaactatcaaaagtcattcgttattccactcgcactatctggacaaacaacccaaaaatcttttgataaagattccctccgagtggccgtgacgcatgagttttcagatttacctggaggatcttatgttgacctttcagccgtaacgaagaaagaaattttaaataagatcgatcatattaaactaaattcagatgccatgctgaaaacgttatataagcaatttaaacaagagctagggcgctctccagaattaattgattttctatactctgaacaggcacctgggcttaccttttttataaagaaatacaaatcgtgggtacagaccaaaaagaaaatggacgatttgaatgttacagatgaagggattctcaataaccccttggttgtagggatagtagcaaaattagaacagcaattacctattaaatggccttatgaatggttaattttacagagcggttttcacaaaaatatcatcacaatagaagatgtaaaagaatcgttagaaaaacagtttcatattcaaaccacaacagatacacatgatgacctcattcagcgagcaatggagcgtttaacgaaatcagatcaaaaacagaattggcgctttggtacattacaaggtgatacattcaagttagatccagaagtaagcgagattttaaccgatccattattcggaccgtatattaaggagcgcgtccactatggactgattgaatttagacgcatgaacaatatagaagcccttgcttcaaaagagattaagctaacattgtatcagacctatacaagaaatgagctcatttatctttttcagtcaactgatcaggaagggacttggcgagagggtgtacgtagagttaaaaatcactatttaatctttatcaatttgaataagtcagaaaaagtagaagatcatttgctatataaagattattttattgatcctagccattttcactggcaaagtcaaaaccaaacctcacatacatcaagcgtagggcaaaactttattcaccataaggaaaaaggatatcatattcatttatttgtgaggaaattcactgaaatgcacaacatcactttaccatttatttatttaggagaagcggattacgtatcaagccacggagacaagccaatgaatgtcaaatggaagctccatcagcctgtcccagaaaacttgtatgtggatttaacgaattaaagcagatacggtcggaagatcagcgggtgcccactctagtgattctagctcacgaataggcacccatctgaattccgcatgctcttttgctaccggcttccctgatacaatcttcgcttttattgaaattaaattgacgatgaccttctcatattcatgatgaatatcagctatcacatcgcccgcaacaattttacaatcaagttcctcttcaatttctcttacaagtgcttcccgagcattctccccttcttcaagctttccaccaggaaactcccacagattaggaagagacattgttggagaacgtagagcgcatagaatttcattgttttcattttgtataactgcggcggctacttttattgtttttttcaaaattaaacttcctttcgttttttcttaggtatgtattcatatttttgttatcaattttatactgttcactgtaaacgatagaggttgagtccatcataattcaaatggtttattaaaagcaatagaaggtcattctcctaattagcaagaaaaaagcaccctccaaactggagtaggtgctttttcacttcactccccaaacagcctccccatcaccgctcagcacactaaacgtcacaacttccttctctctcgctgagtcccattcttgcaggaagacaccgtcataatgtgtgccgttcaggttgattcgggctttgctgctgtcggttattgtccaggttccggtcatttccccggaaatggtgccgtcgttgttaagccggatggtttttggggttttgatcgtagctgtaatgtcttttccgtgctggatgagtttgtaggctccggatgcggcggctgccgatatgtgtgtatccggttctcccgcgtagcggtacggcgctgcaacgggccatccgtctttgttcatgtacagccgatgcactctgacttcgtgctcttcgcctctgttcgggaaacgggtgtggaaaatgaggtatgatcgtttcgttttcccgtcgtaaaacacggagttgtgtcccggtgaaacgtagcccgtgcctttttcagattgtgaggcgaagctgtagccgcccatgagtttgaccccgtacggttcaattgctttgtcatcgaagaaactgccgtcttttcctttggcgtcaagcatgttatggcctgcggcgtcatagtacggaccgtccggatttttagagcgcgccacacgcatattgtagccgccggctgtgtcaagtccgccgaatgacagatacagatagtaatatttcgtttccggattgtagctgatgtacgggccttcgattctgctgtgatttccgccgagcagtttttttccgtagccttggttcgggagcgggaaaccggttttcggattcatttccagtataaaaatccccccgagtaagagccgtacacaatccagagcttgcctttatggtcaaaaaacgtttgcggatctacgacgttcgggtgaacgtttgcatgatacgtcgtgccgtcttcgctttttccttccatgcctgatttcaaaaagatgcctttgtttttgtagggtccttcgattttgtcactcacggcgacaccgagagcggatcgcggcgagtctcctttacaggcgttatagtacatgtaatatttcccgtcagccagctgagccacatccggcgcccacagcgtatcagactgggcccagtcgaatgtctcttttaattcggagtagacgttcgggatcaagggattattgggattgacgcttgaagacagttgctgccactgcatcaggtttttcgacttggcggaagccaaatgcgagccgaatacatagtatgtatcgcctgttttgatgacggacggatcatgcacgctgacctctgaaaaaacgggatgctgggcttttgcctgcggcagagtgaacccgataactgctgctgagaccagacacacacgaaagaaactggttttcattttctgaaatctcctcgctctcttcttttcttaaaacgctttcaagacaacgctccattttatgacgcggatggcggaaatatgtgatcaacagcgccggcttcccgatgtaccgctttaatacaatagcaatctgatttgtgaaagactggaaaaaaagttttgacttctgattcgcaaacacttaatataaaaaacagttactagttatcagaatatttaagaattgagtgaagcatatatgaccttacacaaagaccgccgcatcgggcgattgtccgtccttcttctgcttcatgagactgaagaaaaccagcagatcagccggctggaacgggacggctggaaagtctgtctcggcagggtgggttcaatggatgcgcataaggtggtagctgcaattgaaaccgcttccaaaaagagcggcgtcattcaatctgagggttatcgcgaatcacatgcgctgtatcatgccacaatggaagctttgcacggagtgacgcggggcgaaatgctgcttggctcgctgcttcgtaccgtgggcctgaagtttgccgtcttgcggggaaatccgtatgaaagcgaggcggaaggcgattggatcgccgtttccctttacggcacgatcggagctccgattaaggggcttgagcacgaaacattcggagtcggaattaatcacatatgaatcagcccatagatttcagatgatagggggctatgcgtgaaatatcattttcatggcatagctcctttttgtatgggcgctttaccaaagtaaagaaaaaggggttgaaatgatggtaacgttagacggttcctcactgacaaccgcagatgcccagcgtgtgctgtttgattttgaagaggttcaagcatctgccgaaagcatggaacgtgtgaaaaaaagcagggcggcggttgaacggatcgttcaagaagagaagaccatttacgggattacgacggggttcggcaagttcagcgatgtgctgattcaaaaagaagacgccgcggatctgcagctgaatctgattctttctcacgcgtgcggcgtcggtgatccgtttccggaatctgtatcgcgggccatgctgcttttgcgcgccaatgccctgctgaaaggcttttccggcgtacggactgagctgattgatcaactgctcgcgtttctcaatcatcgcattcacccggtcatcccgcagcaagggtcactgggggcgagcggagatttggcgccgctttctcatcttgcactggcgcttatcgggcaaggcgaagtcttttacgaaggggcccggatgccggctgctcatgctttagaaaagacaaaccttcagccggccgtcctgacctctaaagaagggctcgcgctgatcaacggaacgcaggccatgaccgcgatgggactgatcgcttacctcgaggccgaaaagctggcctatcagtcggaacggatcgcgagcttaacgatcgaaggccttcagggcattatcgatgcgttcgacgaggacattcatgccgcccgcggatatcaggaacagatggatgtcgcagagcgaatccgctattacttgtcagacagcaagctgacgaccgtccaaggggagctgcgtgtccaggacgcctattcgatccgctgtatccctcaggtccacggcgcatcatggcagacattagcgtatgtaaaagaaaaattagaaattgagatgaatgccgcgacagataacccgctcattttcgaagacggcgccaaaatcatctcgggcggaaactttcacggacagccgatcgcctttgccatggattttctcaaagtggcggcggccgagcttgcgaatatttctgaacgccgtatcgaacggcttgtgaatccgcagctgaatgacctgccgccctttctgagccctcagcccggcttacaatccggagcgatgatcatgcaatatgcggcggcctccctcgtgtcagaaaataaaaccctggcccatcccgccagtgtcgattccattccttcatcggcaaaccaggaggatcacgtcagcatgggaaccatcgcctcaaggcacgcctaccagatcatcgcgaatacgagacgggtgcttgccgttgaagccatttgcgcgctgcaggccgtggaataccggggtgcggaacattgcgcctcgtacacaaaacagctctatctcgaaatgagaaacatcgtgccgtccatacaagaagaccgcgtgttttcttatgacatcgaacatctgagtgactggctgaagaaggagtcttttctgccgaatgagcatcaccaaaaactgatgaccaatgaaggaggacttacaagatgactgatgtaaagaaatcaatccgcgccggccgcggcaccgaacttgaatgcttaggatgggagcaggaagccgtgctccgcatgctccgaaacaaccttgacccggaggttgccgaaaagccggaggatctgatcgtatacggcggcataggcaaggccgcgcgaaactgggatgcttttcacgcgattgagcgctccctcaaaacgttaaaagatgatgaaacactgctgatccaatccggaaaaccggtcggactgttccgcacgcacagccgcgcgccccgcgtcctgctggctaattcggtcctcgtgccgaaatgggcggattgggagcatttccatgacctcgagaaaaaaggactgatgatgtacgggcaaatgaccgccggcagctggatttatatcggttcacaaggtattttgcaaggcacctatgaaacctttgcggagcttgcgagacagcatttcggcggcagtctgaaaggaacccttacgctgacggccggacttggcggaatgggaggcgcccagccgctgtccgtcacgatgaatgatggcgtcgtcatcgccgttgaagcggatgaaacacggattgataaacggatagaaacaaactattgcgaccggaaaaccgcatcaattgacgaagcgctgcgctgggccgaaacagccagacaagccggagaacctttatcgatcggccttctcggcaatgcggcagaggtgcatcatgagcttttgaaccgcggcgtccatattgacatcgtgaccgatcagacttccgctcacgacccgctgatcggctatattccggcaggatactcacttgaggaggccgaccgcctgcgccgggatcagcctgatttatacgtaaggctttccaagcagagtatgaaaaagcatgtggaagccatgctcgccttcaagaaaaaaggtgccgtcgtctttgattacggcaacaatatccgccaggctgccaaagatgagggactcgccgatgcttttgattttccgggattcgttcccgcctacatccggcctttattttgtgaaggaaaagggccgttccgctgggccgcgctgtccggtgaccctgaagatatataccgcacggacactttattaaaagagctgtttccagaaaatcaagcccttcaccgctggattgacatggcgcagaaaaaagtcacgttccaaggcctgccgtcccgtatttgctggctcggctacggtgaacgggaaaagatggggctcgccatcaatgaattggtcagaaacggcgagctgaaagccccgattgtcatcggaagagaccatttagactgcggatctgtcgcctctccgaatcgggaaacagaagcgatgaaagacggaagcgacgcggtcggcgattgggcggtgctgaacgcgctgatcaacacggcatcaggcgcaagctgggtttcttttcaccacggcgggggcgtcggcatggggtattcccttcacgcgggaatggtcgcggtcgctgacggcagcatccttgcggaacaacggctttcccgcgttctgacaagcgatccgggaatgggcatcatccgccatgcggacgcaggttatgaaaaagcggttcaagtcgccgaggaacaagacattatgataccgatgaaaaaggagcggtaacatgccgaaacaaatagataccatactcaccaacatcggccagctgctgacgatggaatccggcggcccccgatcaggcggaagcatgcaggatcttcaagtcacggaagatgccgtcatcggcgttcacgacgggcgcattgtttttgccggacatcaaggagcggagaaaggatacgaggcaagagacattatcgactgcgggggacggctcgtcacccccggcctcgtcgatccccatacccatcttgtattcggagggtcccgcgaaaaagaactgaatttaaaaattcagggtatgtcttatttggatattctggcgcaaggcggcggtattttgtcaacggtcaaagacacgaaagccgcctccgaagaagaactgattgaaaaagggctttttcacctcggacgcatgctgtcatacggcatcacgaccgcggaagtaaaaagcgggtacggactcgacaaagacacggagctgaaacagctgaccgcggcgaaaaaactgggtgagcgccagccggtcgacctcgtcacgacctttatgggagcacacgccattccgcctgagtaccggaacagccctgacgaatttctgaatcgcatgctgcagcttttgcctgacataaaagaaaaaggccttgcgcaatttgccgatattttcacagaaacaggcgtctttaccgtcagccagtcacgggactacctgaaaaaggcggctgaagctggtttcggcttgaaaattcatgctgatgagattgacccgctcggcggcgcggaattggcggcagagctgcatgctgtttctgccgatcatttggtgggggcgtctgacgcaggcatcgaaaagctggcggagtccggaacaatcgccgtcctgctgccgggcacgactttctatctcggaaaacacacttatgcgagagcccgggagatgattgatgcgggcgtacgggtcagtttggcgactgacttcaacccgggcagctcaccgacggaaaatctccagctcattatgtcgattgccgcgcttcatttaaaaatgaccgcagaagaaatctggcacgctgtcaccgttaacgctgcgtatgcgatcggaaaaggcgaagaggccggacaaattaaagccggacgggcggctgacattgtcatttgggaagcgccgaattacatgtatatcccgtatcattacggcgtcaatcatgtccgccgtgtcatcaagaacggaaagacggtcgtttcaagggagggagccgctcttggataagtatccgtttctgcaaaaagccggctccctcttcaacgaccgccatgtgacaaggatcggcgatgtgacggaagcatgggcgggacaaacgatcaaagggccggctttgatcggcgttccgctttctaagtcgtcaatcagccattccggcgcctgctttgcacccggtgcgatccgccgggcgctcggcggcatttccgcatattccgcggagctgcgggagcatgtcattgaccatctgtacgatatcggcgatattcagattcacgtcacggatgtcgtcaaatctcacgaacacatttatcggaccatttatgatattctgacggaccagcctgactgggtgcccgtcattctcggcggcgacaactccatcagttattccgccattaaagccattgcggaaacgaaaggaacaacggccgtctttcaattcgacgcccaccacgatgtccgcaacacagaagacggaggaccgacaaacggcacgccgttccgccgtctgttagatgaaaacatcataagcggacaaaacctgattcagcttggaatcagggagttcagcaacagcttggcatacgaacaatatgtaaaagaacgtcaggcagacgtgcatacaatggagatgatccgggagaaagggcttctccgaacgatacaagacactttgccggccgttcaaaaaagagccgacgccatttttatttcggttgatatggatgtgctggatcaagctcatgcgcccggctgtcctgcgatcggccccggaggcctgtataccgaggaactgcttcaggcggtcaggtatttagcccaggaggctgacatctcgggcattgagatcgttgaggttgatccgacacttgattttcgcgatatgacaagccgggcagccgcacacgtcattttacatgcattgaagggatttaaattgtcacgttaaagtcaaacccggcacgcgtgctctcggctgccggaagattctcatgccacgcaaaaagggggagatcacgatggatgttgatcaaggcggcaatcaactaaagcgcacgatgaaaagcaggcacttatttatgatttcattgggaggggtcatcggcacggggctgtttttgagcacagggtatacattgagccaggccgggccgggcgggacgatcgccgcttacctgatcggcggcttgatgatgtatcttgtcatgcagtgtctcggagaattgtcagtagccatgcctgtgaccggttcatttcaaacgtatgcgacaacgtttatcgggccgtccacggggtttatggtcggtatcatgtattgggtgaattgggtggtgacggtaggatcggagtttacagcttccggtatcctcatgcagcgctggtttccccacagcagcgtctggatgtggagcgcgattttcgcggctctcctttttgccgccaatgcattctccgttaaattgtttgcagaaacagagttttggttttccagcgtcaaaatcgtcaccatccttttatttatcatcttaggcggcgccgcgatgttcggtttgatttcattgcacggttcgggtgaagctccgatgctgtcgaatttcacctcacacggcggactgtttccgaacggctttcttgcggttttcatcgcaatgatttccgtaagctttgccttttcagggacggagctgatcggaattacagcgggtgaaaccgccaatccggcaaaagatattccgcgttcgatccgaaatgtcgcctggagaacggtcatcttttttatcggcgccatttttgtgctgtccggactgatctcctggaaggaagccggtgtgattgaaagtccgtttgtcgcggtcttttcccagatcggtatcccatacgccgcagatatcatgaacttcgtgattttaacggctttgctttcggtcgccaactccggactgtatgcttccacccggatgctgtggtctcttgcgaatgaaaacatgatcagcgcccggttcaaaaaagtcacgccgaaaggcattccgctgaatgccctgctcgccagcatggccgtttcctgcatatccttgatctcaagcatcgccgccccgggcacggtctacgtagtgctcgtggcaatagccggatttgccggcgtcgtggtgtggatgagcatcgccctgtctcagctgttatttcgaaaacattatgtgaaaaacggcggacgcgtcgcggatctgaccttccgcacaccgttataccctctcgttccgatcgccgctgtgatcttatgtttcgcttcatgcgtaggccttgcatttgatcccaatcaaagaatcgccctcttctgcggaattccttgtatgatcctgtgctatctcattcgttttttgagaaagaaacagccgaaacaatccgtccgtgacattcatttggataaaaccatgccataaaaaaaaggcgcatactgatgaggtatgtgcctttcttctgttattccgtaatcagcgtatgaatcagtttcggcgctgccgctttttctgagatgcggatgttgtcatagactttggcggtcacgtcgtcaacgttttcgcggttggcgtaaagggtgacgagcggctcgcctttttcaactttgtcaccgacttttttgcggagcataataccgacggctaggtcgatttcgtcctcttttgtcgcacgtcccgcgcctaacagcatcgctgcgacaccgatttcgtcagcgacgatttctgaaacgacacccgcttcttttgccggaacgtcaattttgtacgccgcttgcggaagtttggacggttcgtcaacgacggaagcgtctcctccctgattgctcaggaactctttgaacttttcaagcgctttgccgtttttcatgacttcctgaagcttcgttctcgcttcttccaatgtctcagcttttttcgccaatacgaccatttggctgccgagcgtgaggacgagttcgtttaagtcttcaggcccttcccctcttaatgtatcaatggcttcttgtacttccagggcattcccgatcgcaaaaccgagcggctgcgacatgtcagaaatcacggccatcgtctggcggccgacgttgtttccgatgcggaccattgctttggcgaggttcacggcgtcttcatccgttttcataaacgcgccggctcccgttttgacgtcaagcacgatggcatctgctccggcggcgatttttttactcataattgagcttgcgatcagcgggatggagttcaccgtacccgttacatcacgcagcgcatacagctttttatcggcaggcgtcaagttcccgctttgtccgatgacggctaccttgtcgcggttcacaagcttgatgaattcatcttttgacaattccacgtggaagccttcgatcgcttccagcttatcaatggttccccccgtatggccaaggccccggccggacattttagcgacgggaacgccgagcgccgcgacgagcggagcgagtacgagagttgtcgtgtcgccgaccccgcccgtagagtgtttgtcgaccttaatgccttcaatggcggagagatcaatcgtttcccctgaattgaccatcgccattgtcagatcggcgcgctcctgatccgtcatatcctgaaagtaaatcgccatagcaagggcgcttgcctggtaatcagggatgcttccgtccgtatatccttttacgaaaaattgaatttcttctgttgtcaattcttttccattttgtttttttacaataagatctaccattctcatgatctatcacctgtccttcatttatgttcagtgaatcaatccgacgatcgccgctgtcaggaagctgacgagcgttgcgccgtacagcagcttcagcccgaaccgcgcgacgacgtttccttgtttttcatgcagccctttcaccgcaccggtaatgatcccgatagaggagaaattcgcgaatgagacaaggaatacagataccactgcctgtgtatgcgcgctgaaatggaaatcgccggatgagagcgtctgcatcgccacaaattcattcgataccattttcgtcgccataatgcttccggcgctcaccgcttcattccacggaataccggttaaaaacgcaaacggcgcgaatacatatccgagcagcgcctggaatgtaatgccgaaaaccgcgttaaaaacgccgttgaccagggcaatgagtgcgacaaatccgatcagcatcgccgctacgacaacggcgactctgaatccatccattatatactcaccgagcacttcaaaaaaggattgcttttcttcttcaggaacgacgatcaaatcctcttctttgctgacggtgtacgggttgatgatagaagcgatgataaatccgccgaataagttcagcacaagcgccgtcacgacgtattcaggcttcagcatcatcatgtaagaaccgacgatcgacattgagaccgtcgacattgcggacgcgcaaagcgtgtataagcgctgttcagtaagataaccgagctgttttttcaaactgataaagacttctgattgccctaaaatcgcggatgcgacagcgttgtaagattcgattttccccattccgttcaccttgcttaacgcaagtccgatatacttcgtgataaaggggaggaccttccaatgctgcagaattccgattaaagcggatataaagacgatcggcagaagcacgctcatgaagaacgtcgtctgtttcgcattcacaagcccgccgaatacaaagttaatcccttctgatgcatattccagcaagtagttaaatccttttgcaaaaccgccgacaagaaaattcccgataccggtgttgaggagaatataaccgagaatcagctgcagcacgagcatgacggcgatcggccggattctgattctttttttgccgttgctggcaagccaggcaagacctaaaaacacaatgattccgataattccgatgagatacttcatatgtgttctccttttatttgtattcgcttacaattttttatgcatcaacaaagaaagaggatggcggaagctttcagcttccgcactgctgattaatagtcgctgctgccgctgtctccgccgctcacgatagagacgcccgcacttgcgccgatccggctcgcgcccgcagcgatcatgctgtcaacatcagcttttgttctgatgccgcctgatgctttgaccccgatgtccggtccgactgtttttctcatgagagcgatatcttcagccgttgccccgcctgtagaaaaaccggtagacgttttgacgaaatcggcgcctgcggataccgccaagcggcacgcacgctctttttcttcatctgtcaaaaggcatgtttcgatgatcactttgacgagcgcttttttatcagctgcttcaactaccgcgcggatatcagcttcaaccgcttcatcatcgccgtcttttaatgcgccgatattgatgaccatgtccacctcagtggctccttttgagatggcatccttcgtttcaaatgcttttgtttccgatgtcgttgcgccgagaggaaatccgataacggtgcaaacgtcaactcccgtgcccttcagttcctccgctgcgagtttgacccaagtcgggttcacacaaacggaagcgaatttatattcttttgcttcttttatcagttgtaaaatatccgctttttgtgtatgcggtttcaaagcagtatggtctatttgacttgcaattgacattgtatgcacttcctttttcctaggatacgtttagaataaccgaattttgaacatatgtaaattggtaattgaaattatgttcaagaattgtcacaattcttgaatgagttttttggccgtatgctgatcggtaatcaaaacgttggcgtactttcctttcagggcaccgtgaatggctttgcattttctgctgccgcccgccaccagaatcgaacgctctttcattttcaagtcgctgagctcaactccgatcgtcctgccgttaatgctgctgctgcaaatcctgccttccgcgtcaaaaaagcgcgaacaaatatcgccgactccgcgtgctttcagcaattgtttctcttcttcccggaaatagccgagtctgaaaagcagcgcctcatcccggacggttccgaccgtaaacagggcgatattggcttgtctgcccatttcaatgatccgcttaatatgcctgtcccgctcgaccatctgcttcacatcagcgctgtcaaatataaccggcagcggcaaatacctcggcatggtctgaaatgcttcggcgaacagctgaatcgtttctgacgaatacgtattgacattggaatgactgatgccgcctttcagctgcacgacttcaacgctctttacctgcttcggctccatgcggcttgcgatctgatacattgtcgtcccccagcttacgccgagtatatcgccgtcctttacggttttatgcatatagtctgcgccatagcggcttaagtaatgtgtaatggcctggtaatcgtcgcttggagaaaagacgacgtgcgcctcaagcagcccgtatttttcttccagctttgcgccgagttcgtccagatcctcaaacgggtccatgacgcgaatttgcacataccctttttcctttgcgtactgaagcagccttgaaacggtggggcgtgacagattaagccgttcggcgatctgctgctggctgtaatctgattgataatatagttttgccgcttctatgctgagctgctgtttttcacgatccatgtcgcgcctcccctctccgcttatcatatcaccaaaacacgcggtaaaaaagcaccctctgatggggtgcctattttttcagcacaagctcctgaatcgcatgcgccacgccgtgttcgttatttgatttcgtttcaaaatcagcaatctcccttacttccgggatggcattggccattgccacaccgcagccggcccactgaatcatggacatgtcgttgccgttatcgccgattgccatgacgtctttctgttcaatgccgagtttttcggccagcagcttgaccgcgtttcctttactgactttcgggtgaagaatctcatggaagaatggcgcgcttttgaccattgtgtatgtttccctgaatgattccggaatggaagcgatcgctttctccagcttgtccggatcgtcaatgaacatgactttcggaatcagaatatccttcggcacttcatcgatcgtgcggaaatgaagcggcactttcgtgatatatgattcgtaaaccgtgtattcactgatatcccggttcggcgtgtacagattggctgtgtcaaagtaatgcatcggggtatccagctgtaagctcagctcgtaaagcgactccaaatcttcaaagcctaatgactgctcggccacgacaccgtttgtatacgtattttggacgagtgcgccgttataggcaatcacaaagtcgccttcttcctgtaaattcagctcttccaaataccgacgcacgccgccgatcggccgtcccgtgcacaggacgatattgaccccttccgctttggcggcatcaagcgccccgcggacttcagccgtcacttcatgatgatcgtttaatagtgttccgtccatatctattgcgattaacttgtacatcctgcatctcctttgtatccttttctgcttatgctttcatcatatcgttttttcgtttcaatgaaaaatcaaacggacaagtttctccgccttctcttcgtataccgggcctgcctccggatgcggggccgtcttttccccttgtcagcttgttcgccgccgtcatctgttttctgcttcaagagcatcagccccgccgcaaagaaagggacggccgctatgtccagaagggcaagctttattcccatcgctgcgggaaagtatgcccataatgaacggctgttccgcctgatcatgatataagaaacgatttccagcaggataaacagagcgttcacccataagtaaatgagcatcgccgcaaacagaaacagcaggagcgtattccgcagcgtgccggaaaacagaagagcgcgcatcatatcaaagaatgaaaaagactgcatgctgccgttgacgacattgggattataaatggtaaaacgcccgaactgatcaaaaagcataaaaaataaccataacagtgaaaaccattgaatgatatgtacgatgacacccgtcaaaacgagtctgtcggcagccttatttctcatgtgcatcctccccgccggtttttattcttgtcattgtttttgtttctccgtatatcttccaaatgagcgtatcgttttttcctcttttcaacgtgcttttgacggggtgcggatgtccgaggtattcaatctcgatcgttccgtccgtgttttgtgagaccaccttgtaaacatctgagggcatgggaacctcgccgcggcctttaatgacctgctttgtcagcacgctgtctttcgtaaacgtaacggtttcagatctgaccccgtccatcgggcccggtttcagccccgcatcccatgtcccgtaataaaaagggggttcgtctgctttcttttgcgagcagcctgttatcatgacgcatccgataacaagaaccgtcatgatgaaaatccgtatgttccgcaacatgatcaccttcttttgaagctttttttacgcctgtaagttaggcggatgccgtggcactgtgcaattgactacatagtgtataaagacttcactagataaggagaatgatgaatgaacccatatcagtactacaccccatctgcctatttccctcagcagcaggaatacgaagtgagccccgttgagtatgagccgtatcagcagcaggaaagctattattatgcgccccctcagtctgaagagcggcagccgacggctttagaacggagagtcgcccaacttgaaagacaaaacgcccagcaaacgagagagctcacccgcctctcacaagaagaccagcgccaaaaccgggaaatcacgcgtatgaatgagcagatcagacggctgagccagtccattgaaatccatacccgccgcttaaaccgtttgaatcagcgcctgcgcgcagtcgaaaacagactcaatattccttttcacgctacagaaggcggcttctgagaaaaagggccggaatacaaagctcgacaggccatcccgagccttgtattccgctctgtacataacaggtaaatatttgaatccccttcttgcatgaatgcctctcctattctttcacatgataaatgtgtaaaatcaatcactccgggaggtattcatgatgtatcaaaaccaatacagcggaaatcagctgcagcaatgccgccaaacagcacagcagcttattcagcagacacagcaaagcagtcagcagtacaagcaaatgctccagcaggaacagcaaaacattcaaatgcttcagcagatgcttaaccatgaacagcatgccgttcataccattcagcaagcgctgcaggggcatgaaatggccattcagaaatgccagcaaatcgtgaatgtgtgcaatcagcttcagcaggaagtaagcggacacatgcctgcaccgatggcaaacgctaatgtttcttcattcccgcaaacacagcatcacacaccgtttcagcagcattcataccagcaataggccggtcatgcaaatgacaaagcgcgagataccggctttgtcatttgtttttatctctgttttgtcagatcaatgcgttgagcgggttttccgccgaatttttcctccgcctcatgccttaccgcttcaaacgctcttgcttcgacgttttgtttaaacacatcaagctgtattaaataagccgcccgcactttcagcccgtggatgatggagatgacccataaaggcagcacgatatacacgcccggcgtgctcggcagaacaaaagcaattgctaaaataataaaatagataagtccgtatttcagccattttttgttcttggcccggtagccgatatagaaaaaggccaagaaagcggtcagcccaaacggcgcgaaagtcagcagcagccaccagctgtgcagcacttcccaccaagtccctcttttcgtaatcaacattcattcctcctcctttactactataacatggataatcaaggaaggttttctataaaaaacatagacggaatgacgtcttcctgctatattaataatgataatcattatcactgaaatagggggatcattatgaagaaacaatcatggctgatcggcctggcacttctgcttgttttcgcattaagcgcttgcagcggcgcgaaggaaaacaacggatcggcatcaggcaaaggaaagacagacatgcgtacatatgaatcaacaaaaggaaatattgacatacccgcacatccgaaacggatcgtcactgacttttatgcaggtgagctgctgtccgttgacgcaaatgtcgtcggggcgggctcatgggctttcaaaaatccgtttatcaaaaaacagctgaaaaacaccacggacatcggcaatcccgtcaatgtggagaaagtgatgcagctgaagcctgatttaatcgtgctgatgaaggatgaccaatacgagaaactatcgaaaatcgcaccgacgattgtcattccttttaacaccgcaaagaatacgaaagatacggtcagcctattcggcgacattgccggggcgaaggataaagccaaaagctttatggcagacttcaacaaaaaggccgaagccgatcaaaagcgcctcaaaaacgtgatcggcaaagacgagacagtcggcctttatgaaacgacggataaaggcgaaatctggatttttaatgacaattccggccgcggcggccaagccgtttataacgcgctcggattgaaagcgccggccaaaatcgaaaaagacatcatgaaaacgggcgccatgaaacaggtttcccaagaggtcatccctcaatatgcggctgattatatgttcattaccgattacaatccgaatggagaaagcaaaacatttgagcgtctgaaagagtcatccgtttggaaaaatctcgatgccgtaaagaacaaccgtgtctttatcaacgatttcaacaccttctatccgtatgacccgattgccgtcagcaaacagatggatatcatcaccgacatgctgatcaaacgggctgaagaaaataaaaaataaaaaaagcggcacagtcatgacactgtgccgtttttcatgttcactttaattttgactgtacggagcccggcatatcttcaaatctgacttcttcccaggtctcgacatactttcctttcgccttcaccttcaaatacgcgttcttccgaaggtctttcccggcgaaaaaggtcacttcttcttttttcccggatgcgttatatccgtctaatgtatactcagtaccgcccgggctaagatgtttgccatctcgatcaatctgtacataaacatcttgctggtgaataaacggattaaatctgtctgtaacatcattatgaaaaaagagaagtccgtatatgacggcagcggccgccaagacggccaggattgccaatgcttttttcatctgtgcactccccttacttgttcatttttttcaaatagcttgtccgcaccgcgaggaagaacagaagctgaaagatgaaaaaccctccgatggtcagactgagcggccccgctacatcggaatagccttccaccgccaatgttctcaaagcaaacagcgtatggatgacggcaatgacgaaaggaaagaaaaagagaatcgccaattgtatcgtcacgctttgtgccatttcacgctcgctcagaccgattttggccaatgaacggtagcgctcccggtcctcatctaaatcggtgaacagcctgaaatataagaaactcgctgccgcgacaaagaaaacgatcgcgataaacaggccgatgaataaactcaggctcggcagctgcaccgtatcatagtacgtcccggcttttgccataaaatcagaatgcacgtcgatatagttgccgtaaatctcatttttcaaggattggctgatcccaagactgtctttccaatgatcatagctgtagccgtataatgacgctttctcaccgagtgatttcagctgatcaaaggtttgatcgttcaccgcgatgatggcattcagtgaaatcagcggttttttgacttcttttaccgtcagtttttggtcagacggcttgcctttttggttcagcagcttcagctgatccggcgcgtcgtttttgaaattgcggtcatacgtgcccgggaaatagacagcctcattatgtttcagcccgttcagcttgacatggaagtatgttgacacatccgattcgctgatcatgtaaacaggcggaacagtacctccttcctgatagcggacataggaaacatttattttgtctttcttatacgtaaagccgtgtgttttcagttcatgatcaatatctttcaaatgagtctgttctttcgggttattgctgaaagataaatactccatctcataggcggactcttccgccccgacggtcgatttgtacatcgcgagcacgcccgtcgccgtaaaggcaaccgcggaaataatgctgacgataaagaacaggcgggcgttgtcttttaaacgataaacaagatcagaaacccaaatgacgtttttcccgcgcagataaaaggttttccacttcttcagcgcgcgcagaatccagatgctgctttggctgaaaaagaaatacgtgccgatgacggtaagcagtaaaatgatgaatggctcggtcccgtggacattgcctttcagaaccatgccgtacccgccgcacaggcaggcgatgccgaataaggacagaagcacggacggcttcggctccggcttgatcttgtcagtgccctttattaatttgatcactgtatttgatctgacaaaaaggatcgtgaactgcgataaaaggaaaaataagagcagaaatccgccggccgtaatgccgagcgctttccaaggcatgtacagaggcagcgcgtccatttctaaaatataagcgccgaccgtaaagaacgtttttgaaaaaatgaagcctccgataatcccggctgcgatcgacatgacaccgatgatcatgttttccgccgtaatgagctttctcagctgcaccggcgtaataccctgcatcagcagaataccgaattctttatttctcgatttcaaaaatgcgttaaccgaatacagaacaaataagaaagaaaaaacaaagatcatccattccgcggcagttaagccttttttggcgatattattcaggtagccttcctttaatgccggatgaaacaggaacatcgcaaaggtaaagaaaatcaaaacggaaaaggcgctgctcaagaagaatgcaagataggcccttttgtttctcgtgacgtttttataagcgaactgaagaaaggtcatttgcgtttccccccagcatagacagcacatcaagaatctgctcataaaagacttggcggttttctccgcggtaaatctcattaaacagttcgccgtcttttataaagatgacgcggcggcagtagcttgccgcaaccggatcgtgggtcaccatcaaagccgtgacatgatcatcctgattcaggctctgcatcgtttccatgacatcttttgacgctttggaatcaaggtttcccgtcggttcatcggccagaataagtgacggcttatgaatgaccgctcttgcgatggcggcccgctggcgctgtccgccggatacttcaaacgtccgtttattgagcaggtcttcgattccgagctttttcgcgatgccgtgcagtttttcttccatgacagacggcgcttctttttcaagcgttaacggcagcatgatattttcaccgattgtcagcgtgtccagaaggttgaaatcctgaaacacaaatccgagctgcttgcggcggaaatgagcgagctttgtccgcttcagccggtgcgggttttctccgtgaatcaggatatcgcctgaatccggccggtcgatcgttgaaatgatattcaaaagcgttgtttttccggagccggacggtcccatcaccgccgtgaacccgccttcttctattgaaaatgaaatttgttttaaagcttgataggatacttgtcctttataggttttatttatatgtttgacttcaagcatattcgccatgagaatcctccttatggttttattcttgttgatctgggctgctttcatgtagtgccggggcattcagcataaaaaatccccttgacgtaaatccatgttatcaaggggaaacagaatgagctatgttgttttcttaacggagccttacatttttgtaagaaatgaaaatcggaccgatgtcccttcaccgggggacgaactgatgtcgaccgtatgattgagcttgcccgtaatttctttgacgagatggagaccgattcctgtagactcttggaaacgccgtccgttttcgccggtgaaataagggtcaaacacccgcttgatgtcttgcgggggaatgcccacaccgtaatctttgacttcaagcaccgtcctgtcttcatcgcggaagacattcagctccagtctgtcactcttgcctgccgaatatttgaccgcatttgtaaccacttggccgatcgcaaatttgagccatttggcatcggtgtaaatctgatgatcatcgcgaatgtccattttcggataaacgcggtattgaataaaaaatcgtttatagctttgaatgaccgattggagaagctctgataaggacaccgcttcgactttaaaatcccgctcaaacaggtcgagccttgatgaataaaggagcgtctccagcccgaattcaatctgccggacctcttttttgatttgttcaaagacgggctcatcctcttcctgaatgattaaattaatgaccgacagcggcgtttttacttggtgcacccattgattcatatacgtcacccgcccgtcgagtttggcttcggtttcatggagcttctggtgctgcagccgggtcagctccatctgcttttcatacagctctgaacaaaacactgaagaaccgagatacgggatgtccgtcccttcctgctccgagctgagccaatgatacacaccgcggtctttgtaccagcgataggcaagataccccgccaaaataagaagctgcacgcccaatatgtaaaacaggtgggaaaaagaatggagacccgcaaaccagtaataaaagaagacaaacagcccttgaaggagaaaaagcagaatcagcacggcatgagaccggagaaacagcttcatgacagcgccctcagctggtagccttcgccccgcaccgattcaatggaaacaggcgcattcagctcccgcagtttttttctgagccgcgtgatatacacgttaagcgtattatcatcgacgaaaatgtcagtgtcccacgttttttccatgagccggtctcttcccgtcaccttttctccccgctccagcagcacttccaaaagcttgctttcttttttagaaagctcgcttttttcgtcctgaaagcgcagttcaaaccgttccacaaagagctgcacaccggcatattcaaccactttctcaccctgcttggcggcatactctccgtatgccctgcggatctggcttttgattttcgccagcacaatatcgtaggaaaacggtttttcgatataatcatctccgccgttttcaattgccatcacctgatccatttccccgcttctggctgagatgaaaatgatcgggcttgtagagtgctggcggatctggcggcaccaataatagccgtcataagacggcaggttgatatcaagcagcaccacatcaggcttttcccgcaaaaagacatcaagaacagccgtgaaatccgcggcggccacggtttgatatccgtatttttcaaggtaattctgcaatagtccgcgaatatcttcactatcttccacaatcatgattttattcatgcaaccatcctccaaaaggatacggcttttcggagccatcattatttgatgcccccatcataatgctttcatcgcttctctgcaacatgagaaagcgggcctttataaaagacccgcttcaccctttctcaacgtaagatagattatttctaattgacattgttatacttagatggcggcttcggaaaggtaattttaaatcttgtgccaactcccggctgactgtatatatcaatatttccaccatgcgccttgataatttgctgagcaatagccattcctaatccagtcccggagttatttgacgaagcgcttatccctctgaaataccgatcaaataaacattcaaccgtctcttcgtccattcctatcccatcgtcttctattgtaatttgtatttcgttgtcatgtaacacgtcctgatataatatgacctttattttagtgcccggaggattatgtttaatacaattagcaatcaagttttcaactgcgcgctttaggtacctttcatccatattaaaaagtatcttattgtgactggattctaaagcgaatctcttattttctgactccggtagcaacttcattttttctaaagtgtcatgaattactttcactacgtttttttcttcaagatggattggaagcgactcatttttcaattgaaaagttaagttgaaatcttcaatcagcttttccatatattcgacacgttcttccattattaaggaaaaatcacgcacttgctgattttcccactcatattcatttgaagataaaagaaccgtatatcccttaataaccgaaagaggggtttttaaatcatgtgagacaccggccatccactcttctcgtgtcttttccaataattctctttcagccttattcctttgaagcgttgaggtaagttcagacagagcctgcattaattcttgataggtcttatatccagatttattatgtttatatttgcttgaatgaaacttccgatcataaggttcttcatatttttctttagacaaattctcaatccaagatacaataaacagcaggggagcacctagtttttttccgtaaaatattgcaattacaatccctgccataataatagaaacaatccacaagttattcacccaatagaaaaaagggttatttttttccatcggctttcccaatacccacgttaaatcatggttgtttttcgtttcgtaccacgtagataattgataaccttttttggcagggtacatgtaatctgatattaactctccaagaatataatgcttaggtatatttttaggtttattaaaagaaaaaacctcatctccttgttcatctaaaatttgaatccacatccggttctctaataaatcttcttttgctttcgtgtttattgaaaattgtttatctccaacaactgtttgggcaacaatttttttcaaggataattgtggggtttccattttattttgacctaagacgaggctgaaaaatatgatactgcccaccatgagcagaccccaaataaacatgagtaaaaaaagtctcgatacgaagtaaaatgctatcctatttctcagcttcacaataactcctcatctataggctctgcttcaaatatatagccctgtcctcgaactgtttttatccatcttggtctgctcgggtcttcctctaatttttcacgtaatcgtcttacatgtaccattacagtactatctccgccataaaactccccccatacatctttataaatttggtgtttacttaaaatttgattgggatgttcacagaaataaatcagaagtttcatttcctgagcagggcaatcgattcttgtcccgttaacaacaagtcttccggtattgggatctattttaaagtattcataatcgtatacctgttttagagggtaagaagaagagagctgagtcgttctctttaattgggcttttacacgagctacgatttccagtggattaaatggtttagtaatatagtcatctcccccaaaactaaacccttgcaatttatctaaatctgttgtttttgctgttaagaagagtatcggcacatttgtatgggagcgtattttgctgcataaggtgaagccatcagtgtccggaagcatgacatctaataaaataatatttggaagttcctgatcgattttcagaagggtttcgctccctgtcatagctgtggaaatattgctgaaaccttccttttcaaagcaagttattaataagtttaagatatgttcgtcatcatccaccatgaggattttgttctcttctaaagtcataagttatcctcctttttatttcttattttatatgagatcaaggacataaaggtcagaaaaggaaagaatttaactttcgttaagggttcagaatattcttttaatattttaaccttgatattcagggatcaatataactacatacagaaaataaacaatggatgtcgttaagtgaatgtttaggaagagtttcgtttgtgtttaaagaacatcgcttatgataaaagtgaggtgagagacaaatgaatgatcaaatagtggtaacacacgatctaactaaaaagtataaaaagcatacttcagttgatggattaaacttaaggattaggcgcggcgaaatttatggttttcttggaccgaatggtgctggtaaaacaacaaccatccgaatgttattaggtttaattaaaccaacaaaaggaaacatcgaaatctttggccaaaacctaaacaagaatcgtttgcagatattgcaaagaatcgggtcactggtagaatctccaacttattatggtaatttaaccggttacgaaaacttagaagctgttaggaggttaagagggcttccggaacaacgggtcaatgaagtattggaaactgtaaggttatctaaagtagcaaatcgactgactaaggagtattcccttggaatgaaacaacgtttgggaattgcagttgccctgttaagcagtcctgatttattaattctggatgaaccgacaaacggtttagatccatccggtatccaagaaataagagagttaattaaagaattgcctaaatcgggaatgagtgtcgttgtatccagccacctgttgagtgaaatagatcaaatggctactcaagtggggattataaacaatgggaggatgattttccaggactcaattgcaagtttacatcaaaaacgaaaaccactattaaaagtcggtgttagtgacgtaatcgaagcaaaaacaatactaaacaggaaaggattaaaggttgatttacaaaaaaattatttgtggctgtctcaaacagaaccggaatttgtttcagaaatcaattccatacttcttcattcagggctgtctgtatttcgacttgaagaaaagacacgatcgcttgaggatatttttttagaattaactggtacagagggaagtctatgaaaaagttattatgggcagatcaattaaaactgaaacgttcgtcgttattgattgtagtcttattggttcccttactcattatagcatacgagttggtgaatcttacttatcgatctgaatacgtggaaaaacaagctgaaatgttccatgctgggtcaatgtggatgtatttactgtatgataacagtttgttatttggtctaggttttccattagccgccacactttctgcgtcaataatagcaaatatagagcatcaagcaaacggatggaagcaaaccctttcttttcccgtatctagaatgcgaatttatgtaagtaaatttatttgcttagtagtcagtttatttatttcgtcaacaatcttcttgctcggcatggtactgctgggcaaactggtaggattcgaaggcagtgtaccttggggacttttgtttggagatagttacagcatgttagttacagtactgcctataatggcattccagatatggttatctatggtgtttagcaaccaagcattctcaattcttgtaggatcagtatcatctataatgggtttgtttttggctgctgctcaatcaacgagatggtttccgctggcttatcctagtcaatcttcgacagtcattctgcagtatgaaggtataggatataacccagatctttcatcttacctttgcattagccttttcttagggataattatattatttctaggctctattcattttgctaaacgggatgctttgtaaaaaggaggcgaaatacttgaaaaacattttatttgtagaacgtttaaagcttaggcgatcaaagttatggatcatctatttactagggcctttgttaggtgtatccctggcatacactaactttattaaaaactataacctttttatgaatcctggagacaatccctgggtagaggcttggacacaagtggccttatttatgggcccttttgtattgcctatcgtagtgggaattttcgccgcccttgtttgcaggggggaacatgtaggaggcggttggaaacagcttctagccttaccagttaaacactcagatatctttctgggaaagtttctaacagtggtccgcatgatattcattagtatgttcattttaatcctcttatttattggattcggttatatgttaggcataagcgggagttttcctttacttacaattctaggatatggaattagagggatcttagcttgtttaccattaattttattgcagcttattgtttcaatcaggtctaaaacatttggcataccactcgctgttagcattgtttttacattaccggccattattattgccagtacaccattaggtcaagtatatccatggacacagcctatgttagcaatgtcacccgcagatgaatcaccgattcaatcaaatttcctgttttactcaattatggtaataacctgcctcgttctcttggtttacggaataagaagttttactaaacgagaccttacgtagggtatatacggtctaaacttatgagaattcgagacaaggtaaactaatttgactagcgctatgtaaaacagaaatttatatgaaggtaagactaaatctttttggttgtattctttgaaactaaacgactaatggaaaaggtgatgtttcaaggcataagacataagaaatataaagatatcttaagactctttatttaaacattttttacatttaataatatctcttccatttttttgattatgagttaatataatactatacttaataaggggggtgaatacaatgagtcaagaagctatcattcgttcatggaaagatcctttttcccgtgaaaattctacacaaaatccagctggtaacccattcagtgagctgaaagaagcacaaatggataagttagtaggtgcgggagacatggaagcagcatgtacttttacattgcctggtggcggcggtgtttgtactctaacttctgaatgtatttgctaatttgatttatataggctgtttcccttcagaaggaacagcctatattttattatataaaatattagaaaattcttaaaaaacaggagggtaaatcgttggggaaaactctcgtttgttcagaaaatagctatttccaagcatatatgaatcatttattaacgccagatagtaatgaaataataaatgttaacacattggatgaattaaaacaaataatatccaaggaaaatttttcctctgtaatcatcgatacttgccaccctaatgatttagtgttgcaactgataaaatcgatatcttgcccagtcataatacttaactccttagaaactaacgtttcagattataaccctggtccaatattaaatcaaataaataatgtttcaaccctaaaacataatgtttttcaattgtcttttacaacttttttcgacgttggaaagcattgtatttggaaaaagaatgaatatatccctctggcaatacaagaatttaaaattttatatttgctttatttaaattcaaataaaatagtctgttctgaagaacttattgaatacgctgaccttactggtaggtcaagtctctatgtacacattagttctcttagagaaaaagtagaggataatcctggagatccaaagattcttcaaacaaagtttggaaaagggtacctcctatctgacagtacatatatttgtcttgaaaaaaaagcagactcaaaaaatgttgtgtaaaaaggatgacccaaaaatcattttaaaatgacttttgagtcatcccatttatgttagtgaggggtgttttgttctttctctaaaccctttttctattgctaataaagctttgtcgggtgtaattagaccacgattaggttttcttgtacccgtcgcgatctcaaacgccataatttcaactgggtcaataacaatatgcccatcttttcttaattgttcaatattcctggaaacaactgttttattccacattaaatcgttcatattagggaagaaaatagtgttatgtggatgagctaatacagtagttgcaactaaattcattgctacaccattagcagtttgtcctaagatgttcgctgtagctggaataatgcaatatatgtccgcccagcggccaatttctacgtggctatgtctttttccgttttccccatgttctgagtatacatggtcacaaaaataagaaacagtaggagctggaataaggtcttccgctgtttttgtcataacaacccttgtttccttaaagaaacttttaaaatataagagatacgaggagatgccgacagatgagattgatccgcaaatcccgatcaataactttttatcttttaatattgaaatactcattttttctcctcctgtaaattttagactatcatactacacaattattctttttgtggtgtttatttcaaatattaaatattcttaataaacacatataaaataaacctaaacttcttttgaaattcttttaacttttaaataaccctgctatatttatggataattaaggaatcttaattgttcaaatttattaaaaatgaggtgttcaatatgcatacaaaattaaaatggaattcggtatggaatagatcttcttcgataagtgaaagaaaagtaaggcgtccacttaatactaattgggatgaactaacaaacagacgcttcgaaagatggaaaagccttgttgaaagtgatgaggggattcgaattgagaatgtattagccacccaaaatattgatgaagaaactctaaagcatactatcaatgcaaaagaagtggaatttattaatgaaagtgatcatctaggatggctagaaattattcagctagttgatgaacaatcctataaagatgtaaatatagaagttagaaaagatattctcttctttagttttataaaaccatttttgaaaatagcaagaggaaaattagaggaagtattatattctcactctaataaatctctgataaaggaagaacttagtccgtctgtaattgatgattcacttaatattcttggtgaaactttgtcagctataagtagtcggatattaatattggagttaaatgtagcaagggtagcaggaaagctccgaggtgaaacttctgaagaacgagcctcttatttcaataaagtccttttaaatgacccggcatatgttcgatcaattcgagaagaatacatagttttaacaagactgttagcaacaaaaacaatgtattggattcaaaatacttctgaactccttataagatttcatcaggataaagggctattagaatctgagtttactaatggtcaaaaattaggaaaagttatatccatcgatacaggaagtagcgtctcagatactcataacaaaggaaaaacagtcgccattttaaactttgagactggaattaaaattgtgtataaacctcgttccttagaaatagacgtaaaattcaataagtttgtaaattatctaaatggtaaaaatttaagttttgacttaaaaactgtgcacacacttaacaaaaaatcttatggatggacccagtttatctcttataaagaatgtcaggaagaactgcaaattggaaaattttattggcgtattggaagttatttagctatcttatatgcaatgaatgcggtagattttcatatgcaaaatttaattgctgagggagaatatcctattttagttgatttagaatctttatttcataataattccacgtatacagataccagtgcttttagtcgcgcacaagaacatattgaacgttcagttttgcggattgggttattaccgagaaaaataaatagtaaagctggatttgaaggaattgaccttagtgcattaggtgcacaagaaggacaagtatctccgcataaaaccagtacaatagttgatcgagataaagatacggtcaggatagaagaaaaaaactttccaattccagttagtcaacatagacctatgctgcatgggcaaatcattaatagtgttgcttacgaaggagatattataaaaggatttgaagaaacctacttccttttcatgaaatataaacaagacatgctcgaacaaatagattcttttaaaggagttactgtaagacaaatattgcgtggtacatctcgctatgcaaaccttctgaaaataagtttacatccagatttcatgagagacggcttagatcgtgaaatgattttagataaattgtggttagataccaaattgaatccacgattgaaccaagttgtaaatagtgaaaaggacgacttatttcttggggatatcccatatttcacaagcaagcctgaatctacaaatatgtgggattccaacggtcgaaaaatcaacaatttttttaaaacaagtgccttaaatgagacaaaggaaaaaataaatgaaatgaatgaaagtgactgtcatgaacaagtaagctttataaaaacagctattttagtaattaaggattcttatcgtaaacataaagtatttgatataaatcctcgattacacgtatttaacccaaaagatttttttcaagaagctattaaaattggagactttcttgctagtagggcgattgaaggtgaacagttagatggacaagaggatgtatcttggattggatcgtttgttgacaatcaacgagaggatcaattcaagatttcagctgcaaatagttcattatacgagggtgtaggaggtatttctctcttccttgcttatttaggtcgcctctctaacgatgaaaaatacaccaaactatctaaaaaagctttagtggcagtacacaaaaatatgtctgcatctagtgatttgggtgcctttggggggattgcttcttacctttatttgttggatcatttatcaaaattatggaatgatgaacaactattgaaaaacgaacttcattctgccctcaacaaattagattctttgatcgaaagggatgaaaacaacgatattttaacaggggtggctggaacagcagttattttaataaatttgtttaaacggtataaagaagaacaaatcttaaacttgattacaaaatgcggaaatcgtcttattcaaaatattaacgttatggaaaagggagttggatggaaagtcccggcaaacccaacgccagcctccgggtttgctcatggtgcctcaggaattatatgggctctttatgaaatttacgcaattactgagcaaaatgtatttaaagaggtagctgaaaaagcattagaatttgaaagaactttgtttattccggaaaaaaacaattgggcagatattaaacttgaaaacggacagtttcgaaatgataattttgttgcttggtgtaatggcgcagcaggcataggattaggcagaatattgatcctgccacacaatcaaaatgaattgataaaggatgaagcacatgtcgccattaatacaaccctaaaatatggttttgaacatgatcattctttatgccatggtgatttaggtaatctggacatccttatgtacgcaacggaaaactttaataaaaagttaagcgtaaatgtaacagaactaagccataaaattttaaatgatataaagctcagaggatggttaactggatttgaaaaaaataacgaatccccatccttaatgatggggtatgcaggtataggacttggattgcttaagatttttgcaccgactgaagtgccatcagttttgagactccaatcacctttagaactaaaattgtaaaattaaaatgagccttactttgttaaggctctatttcttaggagtgatccaatgagaagaagagttcctctagtaaggcaaatgggacaatatgagtgcgggcccgcctgcctcaccatgattttaagttactatgggagtactatatctctaaataaaataagtgaacaatgtgatgcccaaagaaatggcgtatctgtatccattttaaaatcagtatcagaatactatgggcttaactgcaaagtataccaagtttcatttaaagatttgaaaaaatatatccattcatatcttccctgcatcatattttgggatgaacggcactttgtggttttagaacagattaaaaaaggtctttttcatataattgaccccaacagaggaaagttgagattatccgaagaagaatttaaaagacattatagcaaggtaatcttgacttttacgaagtcagatagatttaaagagatgatgccatcacccgcagcaaagtattatttacgttatatagttaaaagccgtactattgtttcacttatcattctcttttcactgatcacacaagtagtcttcttagccgttccttttttaattaaatatttagtggatcattctttaataagtaaatcaacaaattcttttctatttttaggaattgtagtcatcatagcagtttttatattgggacttgttatgtttctccgcaattatttcacaattaaacttcaagctattataagtaaaagcatttcaaacgattttgtggaacatttattaaaattacctcttaatttttatgaaaatcgaacaaccggtgatattgcaatgagagtaagtaacatttccatgataagggagattatggctaagaatggagtaacagtagtactagatattattactttgatttcattttttattgctatgttaactcaatcatttaagcttgcattttttgctattggattggcaattattcaattcttactaatgatgattttgattccaagaataaaaaatttaatccataatgacttatcaattcaaacaactacacaaagttttttggtggaagctctaagagctatcacttttattaaatcaaatggtttagatcattctatcctaacaaagtggtcaaattactatgataaacaaatcgaagcattttcacagcgataccacttagacgctataatggatagcataagtataagcatccgatattgtgcaccccttctcttattatggtttggatcaaaagaagttatcaccggaaatttaacactcggaggcttattagggtttagcagtttaggaacatctttcttgttgccgattgcttctttaataacaagcatgcaacaatttcaattggtcggtgacacttttgaacgaatgcaagatgttatggaaactgagcccgaacaactcaaccaaacttcaataattgaaactgaactatcaaaacaggacataaaacttgaaaatgtcacatttacgcaccagagcttacatattcttaaagaagtttcattaaacattaagtcaggtactaaattagctctggtaggccgtacaggtagtggaaagacaactttatcaagaattatactggggttatacaaacccactaagggaaaagtattatatggtgaagaagacttgaagaatttaaacctttacgagctccgaaaacaaatgggggtcgtattacaagaaagctttcttttcaatgatactattgcaaacaatatagctggatttaaaagcttatctcaagataaaattgaacaagcagcaaagagagtgcagttacacgaagatataataagaatgccaatgggatataacacaattatcggggaaaatggcagtatgttgtcaggagggcagcgtcagcgcatagcaatagcaagagctatcgtcgataacccttctgtagtcattttagatgaaataacaagtaacttggatacattaacagagcataaaattgacgaatactttgcaaaatcaaatattacccgtattgtaataactcatcgtcttttaagcagccaagactctgatttaatagtggtattagatcaaggaaaaatagtcgaaaaaggaaaacatcaagagttattagagaaaaggggatattattatgacttatggataaaacaagtaggggatagacagaaagctacgctggaaaagccccttttcctcaatgaacccactggaaaaactttgggccgctgactttattttatttcaataacgcgtgctataccctttatctccatgttcgcagactacaatttgaaagactgaaacaaaacaagccagagcaatcccccatttagaaaaaatcttgccgctgtcgaacataaccatgtgtttatcaatgactttgacaccatctacctttaccaatcgctctcagtcagcaacaggttgatttgattgtgatactttggtgaaacgcaagaacgaaataacaagacgaaagcactcacgatgctgtgagtgctttttcttcagccgacctgctgcttagctgctttaccggctgatccgaactctctcattttgcttcgcaccgtctcttccacggcttcaatgccgggtgtcatgtagccgcgcggttcgtacagatcgccgttttcctgaaacatgcgtcgtgtttcgtctgtccaggctaccatacattccgtgttgatattgattttcgcgtggccgagcgtaatggcttttttgatctgatcctgcggaatcccggatgctccgtggagaacgaggggaatatcagtcatgcgggagatagccgccatttctttaaatccgagattgggctcgccctgatatttgccgtggacggagccgagggcggcggccagagcgtcgatattggtttctttcacgatccgtttacattcggcgatatcggcatagcggaccccgccgaccagcccgtcttccatgccgccgaccgtgccgacttctgcttctactgagacgccgtgctttgcggcataatcggcgacttcttttgtcatcgcgatgttctcatcaatcggatgatgggagccgtcaatcatcactgagctgaatccggcgtcaatggcctgtctgcagcgttccgcactgcttccgtgatcaagatggagcacgacgggaacggtaatcgccatttcttccattaacgcgccgaccatggcggcaattgttttaaacccgcctaaatagtcgaccagacgatcggaagccgcggcgatgaccggcgattgctctttttgcgccgcttgcagaatcgccttcgtccattggaggccgttgatattaaactggccgactgcataatgctcccgtttcgcttctgcaagaagatgtttcatggtgacaaaagccatgttcacgcctccttcatgaagtattttgatacgacggcttccgttgtttcctttgccgttttgatcgtttcctccgcagtcagcttataatattcaggtctgaacagctctacggagacaacatcattgaatccgatttcttttaacgctgacagatgggcgtctaagtcaatcgcaccctgcccaggccagacgcggtcttcatccgttaaaaagccgatcggaaagtcttctgtatcgtcgatatgatagatgaaaattttctttccgtccgcctgcttcaagctctcaatattggagcccatcgcgtggaaatggaagctgtcaaacaccagtccgacattatcgcggccgacagcgttcacgatgtcatacgcctgttcaaatgtattgaccgtgcattgcgggtggccgacaaattcaagggcaatgtttacgccgtacggctccgcgatgtccgaaagctcagtcagcacctctgcgctgctctttttgatttcttctttcaagattttccgctctgtcacaagcggcacggccaccacatatttcacgccgagcgtcctgcaggtttccatcatgcttttgaattccgaaatgatctccctatagcccttctcatcacggttgttgaagaaaaccagtgcgttcagggcaagcggtttaatgtgatgggttcgaaaatattccgccagatcggccagtgaatggtcttttaagtattccggcagcttatccattgtgcggatttcaatataatcatagccgtgcttttcgcacagttctaaatcctgtttcaggtttgaattctccagcgtagtcgcttcattaaagcaaagtttcatgtcagcctctcccatccgcattttcgatatgaagggagtccggctggagggcatttttactccgatccgccgaactccatactcagcttatgccatacccagttcttcttttaatttcttaagcatgatccggcttgattcatccgctctttcgccgacccaagcaaacacggcgttcgttgcaattccgtcgaatttcatctctctcatctttctgaaaatcgtctcaaaatcgacctcgccttgcccgatatccaaatgctggtgcaccgttactttcgcgtcaggcggattgacgatgtaacgcaggccgtgcgccgctttatgattaaaagtatctgcaaataaaacatgcgtgaggcggtcgccggcttcatcaaacatggtttcgatatcgcctttgccgtcatcatagaagaacgtatgcgcagtcgagtagacaaggttgatccaatccttatcgagcgcgcggatcatatccatcgcacctttgtgcgtttcgataaaatcgtatggatgggcttgaagattgagtttaacgccttctttttcaaagacgggcagcagctcatccatggatttgatgaatttttcttcacttgtcaacggatcatactttgaaccgctgaattcactgttcatcaaatccacttcaagttcaaccgcaatttcgatcgcccgtttccagttgcgcacggcggcctgtcggcggtcttcatcagggcccgcccagtggtaaagcggaagaagagaggacagcttcacacctgtatcctttaaaaggcgcttcaattgtttgatttttgctgaatcgactttcggatatttatagaaaggacaaaaatcctcgcgcggggacagttcgatatattcgtatccgagctccgccgttttatagaccatttcctctaatgttaaatcatcgcggtacatggatggatctaaggccagtttcattttttcactcccgatctattatttgttcacagtcgtaaatgattgatagaatgccggtttctcttgaagcgccactggctctttctgtccggattcctgagcttttacgcacgcgtctgttgtcaccgcggcaatataaccgtcccatgccgtcggaccgctgacttcgccttttttccggatcgaatcaatgaagtcctgaatttccacatcatacgcagccacaaatcggcgctgccagtccatcagaatatcggtgctgaatttcccttcttttctcaagctgatgcttgacggttccggaagcttaatgacgccgtcttccccgacgatttcacattgaatgtcatagccgtatttacagttcacgtagatttcggcattgatgacaatgccgccttttgtttcgatgatgaccatctgcggatctttcagatgcggcagcgcattttttgatttcttcggatagatgacctgtacgaattcatagtcgtcattgacgagccagtggagaacatcaatttcatgaacgagcgtatcgacgacggccatgtccgttgaataattcgatgcgactgtcgggttgcggtgcgcacagtgaatcatcagcggctcgccgaccgcacggttgtcgatcgcttctttcagctgaacgtaaccgctgtcatatctgcgcatgaaacctacctgcaccaatcgttttcccgtcttcatttcttcctcgacaatgcgcatacagccttctgccgttgtcgcaagcggcttttcacaaaacacgtgcttgccgtgctgaatcgctttcaacacgctggactcgtgagccgggccccagcttgtcactaagacagcatccacattttcagcagcgaggaggctgtcgtcatcaggataaacggaggcgttcaaattgaaatgctgaacggtctgctgcgcggcctcctcattcacatctgtgacagcggtaatttccgctccggacagcttatttgtgatgcggttgatgtgctcttttccgatagcaccggttccgataacacctatacgtaaattcattgatcgccactccttctgataatcaaataatggttctcgtcttttttttcccgcagccgtcctgaggagcaccgtacagttcctcctgtatctgttcaagcgacttgccggacgtattcggtgcgaaaacaagcccgatgatcatactggccgtcacacatatgagcagaataccggccataaaaccgatgccgaattgtgacatgatgaccggcacaaataaactccaaattccgattgaaatacggacgagaaagaacatgagcccttgtgctgacgctctgtgttctgtcgggaacagctcgcttgcccacagctggtagttcgcctgctggccggctccgttattgatgccgatcgctaaaacaaacaaaagcagcatcgggagcccctgaaacggcagcaaaaacagcgaccagccgacaacagccataaaggcgcagattccgaacaccgttttccgatattgatctgcaaaaggcatgaagatacaggcgacgccgagaccggtgaagataaacagggccatctgcagaatgttggccgtatttgcggatacgccgccgacctgctggtagatgtacggcatgaagaatcccatgacgcccgcggcgagattccatacgagaaacacacccattaaaaacaaaatgttcttgaaaaatttcggctgaagcaggtcaaaataagatgtttttttcacggcggcaggccgctcttcactgtttttccaggcatccgactcaggtaaacgctttcttatcacatatgtgatcagggcgatcaccaatagatgcgcaaagacaattttatttcctaaaagcccgaggtcaccgaccaaaacggataacagcagaaccacaacggctcctgcggcccacgccacctgcgccactccgcaatgcctcgcccggtttttctcgggggcgttttccgcaataatggtccatgaagccgtaatatccgcgcctacagaaaccccgataatcatgtatccgcataacagcatgggaaagttgaatccaaacaaaaccaaacaaattcctaaagcgtagacgagcatactgtttgtgtatacagcttttcggccgaccttatcagccaaatacccgccgagcagcgctccgatggccgctgatatcgcgtttgcgctgagggcgccgagcaatccgatctgactgtcggacagcttcaagtagctgacccacatagataaacccgctgatcctgccacgatggaacctgcatcaatgtaatttgctaatgctgcggcgatggtccgtttgctgaaagctgattccgccttggcacgattcatataagtccccctctaatttgcaggatcaagcagttcactgtcgatgtactttctcgcaatcagcgcgtactcaagcggattggcgactgccgggtcttgttcggcttcaatgacgatccagcctgaataatcatgacggacgagcgtttggtacacttcggtaaaatcgatgcatccgtctccgggaaccgtaaaaatgccctgtaaaaatgactgcctgaatgactttccttcctgtctgcaccgctccataatgtcaaaccgcgcgtccttgaaatgaacgtgtctgatccgatccatatgcttgttgagaatcgtcatatagtctccgtccgagatataggcatggccggtatcataaagtaaatggacataccgcgggtccgttccatccatcagccggtcaacttcttccgccgtctggacgcctgtgccgagatgatgatgaaacgtgagatccagcccgtattcgtcagcgattttcccgagacggttcaagccttggcacagtgtatcccattcttcatctgagaagtgcggttttttcttaaatacatcaatgtccaagccctggacactgtacgtctgttcagaaacgatggcggcatccgctccgactttctgcaaataatcacagtgttctgtaaattgttcagccgttttttcaataccgtcttgaatgataaagctgctgaaccatttccccgcaatccgcaagttccggagagccagctccttattgaggacggagggttcagggaaaaaccctcccacttccgtaccttgaaaaccggcgacaacaatatcgcttaacaaatgttgcagcgtattcccggctccgatttccggcatatcgtcatttcgccacccaatgggagcgatgccccacaaaatattttgtttgcccatcgtgatgcctcccctctagtactgcttcgcagacttcagcttcatctctttcgcttcgtatgcccgctgaacgctttcctgctccgacacttccgccacgccgacatgccaccagctgtcatagccgtccgtcatcgttttcggcagaaccttcatttcaattaaagtggatacatcttgcgttttcgcatcttcaagcgccgctttcagttcttcaaccgtattggctctgtaagttttagcgccgtagccctctgccaccttcgcgtaatcaacgtttaaaatctgattgtcctctgtgcggaactcgcagaaatagctgccgctcccgtgatccatctgcaggttgttgatacagccgaatccggagttgtcaaagagcaggacattgatttttttgttatattgaagcgcggtaatcagctcagagtgcagcatcagaaagcttccgtcgccgacgagtgaatagacttctttgtcgggatgagccagcttgaggccgagcgtgcccgatacttcatatcccatgcaggaatagccgtactccagatggtacgtattcgggacattggaatgccacagccgctgcagatcccccggaagagatcccgccgaactgatgacgacgctgtcttcaggaatcgtgtcattgatggtcaacagcgccgttgtttgcggcagctcagtctcgagcgcgtcggcatactcgtttaacacgtcctgtgagaaatggtttttaatttccggcttgaacgcgttacgtgtaaaagtgatcttgccgagccggtcccgttcagccagccattcatctttccagcctttaatcgccgtgccgaatgcacttttatatccgtctaataagccgtgcagcctgccgagcgtcactttcgcatcggctacgacctgaaacgcgtcaagcttgtatgcctgcatgcggctgacgttgatattcaaaaattttgctttgtcaaaatcaaacgctgttttcgaggatgtcgcaaagtccgtgtaccgtgtgccgacaccgatgatcagatcagcctggcgggcggctttgtttgcggcgagtgtgcccgtgatgcccatgccgcccagattgttggcgaaatcggcttcaaccgttgacttgccggcctgcgtttcgacaagcggaatgccgtatgtttcagaaagcgcgattaattcctcacgcgcgccggagtacttcgcgccgccgcccactaaaatgacgggacggctgctctccttaattctctccgcggcgcctttcagctcacgctcgctaggctgcatccggtcaatgtaatgaacgcgtttttcaaagaagctttcatcaaaatcaaatgcttctccctctacatcctgagaaatacagatggtggccgggcccgcttttgccggatctgtcatcacttcaaatgcccggattaagctgctcatcagctgctcaggtcgggtgatgcggtcccaatagcgggacacgggctttaacgcatcgtttgttgtgacggcggcgctgtattcctgctccacctgctgaagcaccgggtcaggctgcctcgttgcaaaggtatcggccggaagcagcagcaccggaatatgattggccagcgccgtacccgcggcagctgtcaagttagcggcacccggaccgaccgatgtcgataccgcgtaaatttttcttctcagcatctgcttgctgtatgccatcgcggcatgcgccatgccttgttcgtttttgccttgatagactttcaggtgcccggcgtcctgctcgagcgcctgcccgatccccaacacatttccatggccgaaaatcgtgaagatgccctcaacgaacggctcttcttttccgtcaacatgaatgtactgccggttcaagaattgaatcagcgcttgtgctgtcgttaagcgaatggtcttacccacaaacgatcccaccttttatacgttctatttaccgttaagactgtgctgcgcttcaatcagttcgatgatttcaccggcagccggcattgcttctgaggagctgtgtttgctgacgacgatggaagcggaagcgctcccgtattttaaagccgtttcaatatcccggccgctgaccagtccgtagatgaaggctgacgcataggaatcacccgctccgaaggtcttcagcacctttgttttataggcgtgcgcccggaaaacttcccccgatctgctgtatgcgtatgatccgtcaacgccgtgcttaatgacgacaaggtcggcggagtgcgcaaacaaatggcggacggtttcatcgttatttccgccgctgcggttttccattacgtcaaattcgtcacgcgtaccgatgacgatatcggattgttccgccaccagcgtgtagtacacggctgtttcttctgccgattgccatgtatactgacggtagtcgagctcaaacacgacttttacgccatgtttttttgcgatttgcaccgcttttaagatggcttcgcgcgacggacttttcgcaagcgccgtacctgatacgagcagcattttcgcgtttgcgatgtagccttcattgacttcggacggctctagatgcaaatccgccacgtcatcccggtacatcagaatgctgcactcttcgggactgagaatttccgtaaaagcgagccccgctttgcgcccttctctgtcaacggtcatttgtgacgtatcaacgcccttttcctgcatataagaaacgataaatctgccgtgctggtcatccgggattttgccgataaaaccggcttttaatccgagcttagcgctgccgatcgcaatatttgccggggagccgccgacatatttagaaaacgtcatcgtttcttccatcggccggttgtattccgccgcgttcaaatcaatacacgcgcgtccgatcgcgacaatatcaaactctttttcttcattaaacgtatatttcatcgttatctgccactcctcacttatcagcgttccagaatccattcatggtccggatcattatgaaacttccattttcgtgtcggtcccgccatgacattcaggtagtaagaggtatacccgtccggaacaccaaccgggtgatagcccgccggcacgatgacaacgttttcattttctgcggtcatcgtctcgtcaatcgagcggtcgtccgtgtacacacgctggaagacaaatccctgcggcgggtccgtttcatggtaataggtttcttctaaaaaggattcagccggcagattgtcttggtcatgtttatgaggcgggtagctcgaccagttgccgctgtccgtgtaaacttcaacaacgagaaggctgtttgccgatggatctgaatcggggagaatgttatgaacggttcgtttgtttgccagcttgccgcgatgttccacaccgttgtcttccgctttaatcagctttgtcggaagctggtgttcggacggagagtagcacagcgcgaccctcgccccgctgacagctgtgattccaaaagagcggtcattggacacataaacgctgtccgtcggttttctatcaaatacgctttcacgggtgccgatgctttcaaatgtctgatcataatcagtgacggtaacttttcccgttaccgcaacgatgcagcactccgtctttttcaaatcttctgtatatgttgagccgggagcaagatcaacgactttaaatccgacgtatttgaggtctgaattggctgaagtgacgtcatgtatgatggtcacgccttgagaaatctcatcggcctgcggtttgcgcagcaaataactcatgtttattcctccttaatggatggtaaaagaaaacccggacggaatcacaaagccgtccgggccggctgtctgatcaattgaagtcaggagacgggtatcgtgccgtcacgacttttttacgtgtatagaagtcgacgctgtcttttccgtttgcgtgcaatgtgccgaagaaagaagacttccagcccgagaacgggaagaatgccatcggcgccgggacgccaaggttgatgccgagcattcccgcgtcaatattctcacggaagtagcggatcgcgttcgcatttgaagtgaacaggcaggcgccgttcgcaaattcagactggttggcgatgtcaaccgcttcttttaaatttttcacacgcatgaccgacagaacgggcgcaaagatctcatctttccagatcgtcatatccgtcgtcacgttgtcaaaaatcgtcggtccgacgaaatagccgtcttccgttacatgttcacggccgtcacaaagcagtttcgctccttcttcgatgcctttttcaatatagctgtgcgtgcggtttttgttgtcctcgcggatgaccggtcccaaaaatacgccgtcatccagtccgtttccgatcttgatgtccgctgctttttcctgtaatttcgccataaactcatcggcgattccctcttcaaccgtcacgaccgcgcatgccatgcagcgctctcctgccgaaccgaatgccgcgccgataatgtttgtgaccgtatcttcaaggtgggcgtcatttaacacgatcgtatggttttttgcgcccgttaacgcctgcacgcgtttcaaatgttcgctgccttttttgaaaacatactcgccgacaggttttgaaccgacgaatgagatggctttaatctccggatgctcaagaatgccgtttacgacgtcatgcgcgccgtgcacgacattgaagacacccttcggcagaccggcctgttcaaacagctctgccagtttttccgttaacagcggcgtgcgctcagaaggcttcagaatgaaagtgtttcctaacgaaattgccatcggaaacatccagcacgggaccatcatcgggaagttgaacggtgcgataccgccgaccaccccgatcggatagcggtaattcgccgcctctacatccgtcgcgatagaggcaagtgaatcgcccatcatgagtgacggcgctcccgctgcgaattcgacgttttcaattccgcgtcccacttcaccgagtgcttctgtcgtgtttttaccgttttccaaagtgatcagacgggcaagctcttctttgttctgctggagaagctgctgatagttaaatagaattctcgcacggcgcggcaccgccgtcttcgaccatgttttaaacgcttctgacgctgagcggacggcgtattccacatcctcccgtgtagaaatcggaacctggcacatcacttcttttgtcgccggattgacaacgtcttcatattgatctgtcttactttcaacccattcaccattgatgtagtttttcagttttctgatctctgccattctcattgcctccttaaatagtaaacatcctgtcagctggataataacggatgaatatattcatctttttcatataaaagacatgaattaaacgcttacaaatgctaaaatgatggtgaatcccaatctttccatgtaaaagttggtcatgtgacggataaagcaaacgattacatctttcaattttgattttacaggttatattttggtcatttcttggttacattgtaagcccaacacaccttcaagtcaatctaaaaaatcaaaattttttcattatttttatcgtactttttttgagcgggaaaacaggaacttggagaaccgtgtcgaatcgtacggtgggaaccctcttttttatcatttgttaagtaactattgattaactcttggtgtttattatatattttaattactttaagaattctagaaggagtttttttatgaaactgatgcggattcaggagatggaagaatacattctcaaacacggagccacttcgctggatgagctgtgcgaggtattcaacgtctctaaaaacacggtcagacgcgatattaataagcttgcggaaaaaggggtgatcaaaaaggtgtacggcggcgtgacgtcagcagaaaaatctgtgctcgtcccttttgagaaccgcaccattcaacatcaggatgaaaaaatcaaaatcgcccgctatgcgtcgcggtttatcgaggatcacgatcttgtatttattgattccggcacgacgaccaaatcgatgctggagacgcttgatccggataagaatgtaacggtgttgacgaacagccttgatattattaacgccgcttcatccatgaaaaatatcgacctgatcatcatcggcaataactacaagcggaagacaaggtcgtttgtcggcattgatgatccgagcaccctcaataaatacaacattaacaaggcgttcatgtccgctaccgggacaacgatcacccacggcctgacgaattccgatttactggaatacgaggtgaaaaagaaaatttccgaaaaggcgaacgaagtgtatctgctcgcggatcattccaaattcggcaaatccacgcttttgacatacgcgcctttcgaccggcttcacagcattgtcacttctcagcagctcgatgaggaatatacgaagtattgccaagagcaccaaatcgacattcacttggcatagcgttatagttaatagagaacgctgccgtatttttccggcaggcgctatgatatccaattttttcagggggcgaaaacatgagcaaagtaacaatcggcaaaactgacctaaaggtatttccgatcggtttgggaacaaatgcggtcggcggacacaatctctatccgaatctgaatgaagtaacgggaaaagaattggtccgggaagcgattaaaagcggcgttaccatgttagatactgcctatatttacggtgtgggccgttctgaagaattgatcggcgaggtgctgaaagaatataaccgcgaggatgtcttcatcgccacaaaagccgctcacagaaaagaaggcaatgactttgttttcgacaactcaccggcctttttgaaacaatcagtcgaagacagcctgaaacgcctgcagactgattacatcgatttattctacatccatttcccggatgagcacacgccgaaggacgaagccgttcaagcattgaatgagctgaaaaaagaaggaaaaatccgttccatcggcgtatccaatttctctttggagcagctgaaagaagccaataaagacggcttagtcgacgtggttcaaggagaatacaacctgctgaaccgtgaggcggaaaagactttcttcccttatacgacagaacacggcatctcattcattccgtacttcccgctcgtatccggactgctggccggcaaatacgacgagaacacaaccttcccggaaggcgacctgcgcaatgatcaggcgcatttccaaggggagcagtttaaagaaaacatcaaaaaagtcaaccagctcaaaccgattgccgaaaagcacaatgccgatacggcgcatatcgtgcttgcctggtacttggcgagacctgaaatcgatatcctgattccgggcgccaaacgcgcggatcaattaaaagacaacgtgaaagcagcctccattacgctatctgctgaagaaatcgcgtttattgataagctgttttcataagaaaaaaacacgcctttttgaaagggcgtgtttttttatgtttatatttttctcttcggggaatgaaatagttatctaaataaactattatgcgttccaaaagatgaggaggatcatctgtgaagaaaaacaccaaaaaatacctgatttactttttcggagcattgggcgggctgctttacggctatgacaccggtgtgatttcaggagctttgttatttattaacaatgatattcctttaaacacgctgaccgagggattggtcgtcagcatgctgctgctcggtgcgattttcgggtccgccttaagcgggacatgctctgaccgatggggccggagaaaagtggttttcgtcctttcactcatttttattatcggcgcgcttgcctgtgcggcttcgcaaaccgtcactatgctgattatctcccgtgtcattctcgggttagccgtcggaggctcaacggcgctggttcccgtttatctatctgagatggcgccgacaaaaatacgcggaacgctcggcacattgaataacttaatgattgtgaccggaattttactcgcatatattgtgaattacatattcaccccgtttgaagcttggcgctggatggtcggtctcgcggcagtaccggcggcgcttttattaatcggaatcgcgtttatgccggaatctccgagatggctcgtcaaacgcggccgtgagcaggaagccagacaagtcatggaaatgactcacgacaaagaggatatcgccgttgaattggcggaaatgaaacaaggagaagctgagaaaaaagaatctacactcggcttgctgaaagcaaaatggatccgccctatgctgctgatcgggatcggcctcgccatcttccagcaggcggtcgggatcaacacggtaatttactatgcgccgaccatctttacaaaggccggactcggcacttcggcgtccgttctcggcacgatgggcatcggtgtcttaaacgtcatcatgtgtatcaccgccatgatcttaattgaccggatcggccggaaaaaactgctgatgtggggaagtgtcggcattaccttgagcctggcgtcactatcagccattctccttctggccggcctgtcagcttcaacagcttggctgaccgtgctgtttctcggaatctatatcgtcttttatcaggcgacatggggtcccgtcgtatgggtcctgatgccggagctgttcccgtcaaacgcacgcggagccgcaaccggatttacgacattgattctgtcggcaacaaacctggtcgtttcactggtattcccgcttatgctgagcgccatgggcatcggctgggtattcggaatattctcagtcatctgcctcacatccttcttcttcgccgcttacatcgttcctgaaacgaagggcagaagtttagaagaaatcgaaacgcacttgaaaaaacggttctccttaaagaagcgcagcaaacaaaatcaaattcttaaacagcgcacactgtaatcaaaaaaggaatcgcccccgctgggcgattcctttttggcgtcataccataactttgcagatgtcattcgtaaactcgactggatcatggatcggcagtccttcaatcagaagcgcctgattgtacagcaggtttgtgtataaagcaagcttttcccgatcttgcccgtgcgcgttctttaacgtctcaaacacttcgtggttcgggttgatttccagcactttttccgctttgacctgctggctgtcaggcatggcgtttaatactttctccatttcgatcgtcacttcgccgtctgtcgcaaagcagaccggatgggattttaagcgtttcgatgctctgacgttcttgactttatccgcaagaatctctttcatgctttcgaacaggtctttatattcgttttcttcggcttcagtctgcttttcatcttcgtcactgtcgatgcctaagtcggcgcttgagacggatttgaactctttttcctcgtagcttgtcagcattttgatcgcgaattcatcaatatcttccgtgaaatataaaatttcgtagcctttgtccgccaccatttcagtttgcggcagcttttcaatccgctcatatgaatcgccggacgcgtaatagatatatttttgatcctcaggcattctggacacatattcgtccagagtgacgagctttttctccttagatgaatagaagagaagcagatcttttaagacgtctttattcgcgccgaaatcattatagacgccgaatttcagctgtctgccgaaagattcatagaaagattcgtatttttctcttttgttcttcagcaggctcttcagctcggctttgatttttttattgatgtttttcgcaatcagcttcagctggcggtcgtgctgcagcatctctctggaaatgttcagcgacagatcctcagaatccaccatgccttttacaaagctgaaatgatccggaagcaggtcggcgcatttgttcatgatcagcacgccgttggaatacagctccaatcctttttcgaattccttcgtataatagtcaaacggcatgttttccggaataaacaaaatcgaattgtagcgcaccgctccatcgacgctgatatgcacgtgggtcagcggtttatcaaaaccgtaatgcttctcggcgtaaaaagcctcgtaatcctcatccgtcagctcgcttttgttttttctccagatcggaaccatgctgttgaccgtctgttcttcctgaacttcttcaaattcgttctcgctgccctctttcggcttgttgaccgtctcttccattttgatcgggtagcggataaaatcagagtactttttcacgatcgctttgatgcggtagttttctaaaaactcatcatagctttcatcttctgtgttttcttttattttcagggtgatttccgtaccgacggtttccttgtcacacggcgcgatcgtgtagccggcggccccttccgactcccatacatacgcctcgtcactgccgagcgccttacttttcaccgtgactttatcagccaccataaacgccgcataaaacccgacgccgaactggccgataatgtcatggccgtctttcgagtcattttcttgcttgaaagcgagtgaaccgcttttcgcaatcgtgccgagatgctgttcaagctcgtcttttgtcatcccgataccggtatctgtgacggtgagcgttctcgcttctttatccgccgtcacttttatgtagtaattgtcttgatcaaacgttaatgaatcatcggttaacgccttgtaatagattttgtcaatcgcatcgctcgcgttggaaattaactcgcggagaaaaatttccttctgcgtgtaaatggagttaatcatcatgtccagcaatcgcttggattctgctttaaacttttttttccgcacttcagatctctcctttaattatgctttgatgttatgtaaaatcttttcagcatctatttatcatatacagtgacaattgtcaactaggattagcagatgcatatattgtaaatttaacatgttaatggattcatttcacccattttatcaataaaaaagagagaatgttgatcatcctctcccctctgcttctttccggcggccgaattccttcttcatccatatgtatgacgggtagaaaaacaaactaaataagataagagatcccaagtttcgcaaagactcatgcagaacatttcttacagtgagaggaaacgtgatgtcctgaaatagaatagagataacggtgtaaatcacaaatcccataggaacaatggcataacaataaaacgctatctccttcttatgctgtatcttcaaaatatgtaaacctcccaatgatgtatatacataatattaacatatttaataagtatttagaaataaacctccgtatgtttatccccctattcagcgggaacagttataaaaaaaggaggcatcgcaatatgggaagattaacagacaaaaccgcaatcatcacaggggccgcgacaggcatcggacaagcgacggcacgggttttcgccgatgaaggcgcccgcgtgatctgcggtgacatcaatgaaagcgaactgaatgaaaccgtcagcgccatcagaaaaaacggcggagaagcagaagcctttcaccttgatgtatcagacgaagaaagcgtaaagtcttttgcggacggcattcagcaaaagtacggaacaattgatattctgtttaacaatgccggtgttgaccaagagggcggcaaagtccatgaatacccggtcgagctttttgaccggatcatcgccgtcgatctgcgcggcacatttctgtgcagcaaatacctgattccgctcatgctcgaaaaaggaggctccatcatcaacacctcctccatgtccggccgggccgcagaccttgaccgctccggctataacgccgcaaaaggcggaatcacgaacctgacgagagcgatggccattgattacgccagaagcggaatccgcgtcaattccttatcgccgggcacaattgaaacgccgctcattgataaattggcaggcacgaaagaagacgaaatgggcgaggcgttccgtgaagccaacaaatgggtcacgccgctcggccggctcggaaaaccggaagaaatggcggctgtcgcgctcttcctcgcttcagacgacagctcttacgtcacgggagaagacatcaccgcagacggcggcatcatggcatacacttggccgggaaaaatgctgattgataagaagtggaaggaagagacggagtgacgatagataataaaaaaagccagtgtaaaaaaacactggctgaacaagctgagggcgggttacttaaaccagcccttttcctttgatcgggtaatggcttcaattcgatttttcacttctagtttatccagaatcatcgaaacgtaattgcggactgtgccgcttttgatgctgagggcgtttgcgatttctttcgtgttttttccgtctgcgacaagctcgagcacctctttttcccgttcggtcagcgggttttcttcactatagatgtcctccattaattcaggtgcgtagacgcgtcttcctttcatgacgctgcggatggcgctgacgagctcatcgctcgggctgtccttgagcatgtacccgctgacgcctgcttttagcgcccgctgaaaatagccggagcgggcaaaggtcgtcaaaatgatgattttcacaccgctgtccttgagttcttctgccgcttcaagacctgatttcccgggcatttcgatatccatcagacagatgtcgggcgcatgtttttccacgaaatcgatggcatcctggccgcttgtgcctttgccgacaaccgtcatatcctcttctaaattcaacagcgaaccgagtgcgccgagcagcatttgctgatcctcggcaatgaagatgttgatcatctgctaccatccttttcttttgattttgaatcattcgggattctcatggtcagctttgttccggcggctgtatcgatggctaaactgccgtttgcgaattcaagacgttccctcattccaagcaggccgtgcccctttgaaaaaaagcggtcttctctgcattgaaagctgccgtcgtcttctaccgtaatgacgacctctttccaaagctgctgaatggtgatgcggcatactttggcgccgctgtgtttcacgacattggtgacggcttctttaatgcacatgctgacgatgttttcgttcagcaaagagatatgtttgggcgcttctttttcttcatacacaaattcaattcctgccgcttcaagaatttgccgaacattgccgagctcatccttcaatcggatgcctttcatcgatgagacgatttgtctgacctcatttaaggaggtgcgggccgtctgctgcacgcttttcagctcagtgcgggcctgttcaggatccttatatatcagctttcgggcaaggtcgcttttcagtccgattaaggagagcttttgtccaagtgtatcgtgaaggtcccgggcgatacgctgcctttcttccagcttcacaagatcggcaattcgctcatttgcatattctaatttctcctcaaggcgctcccgtgcctttctgcttcgaatgctgagcggaagcaggatggcactgatcaatgtaatgacgataaacggaatttgtgtcaaaaaccactcttttttcagaacaaggctgaagttgacggcaaccgccgcactgatgatatgaatgtaatataagatgtaaaatggaactttgtctcggatatggccgatgaagtaggcgataaagaaagcgaaataaatataactgaacagcatggctgagccggtcgaaatgccgatcagaagaagcgcccataagtaaagcggccagccttttgcaacaaatgcaaagcggtatgcgccaaagaaaacgagcgtgaaaatgatgccggccacgatgacgaaggtagaagagcttttaaaaataaaataaaaaggcaggatgaaaaaaatcgtccatatataaggagaaatcccgttcagtttttgaaatttaaaatacttcttcatctttgttccaccttctgctgcttgtgtctaccatcactttatcaaaacaccgccttcattgcaccctcacgcatgaagagaaggctctttctgataagagaaagagccagccgtgcgccgtatcaggcatttttctttaaaggttctttcggcaccggatggggcgccggtgttttccgcgcctcccgaaaggtgacaaactgcttttcgtcctcatcccacagacggaatttcatggattcaagacttgttttaagcgtaatggtcggtacgttttttaaaggctcgtgcccctcatgagccgcttccagcttgtagttcggcactttcgggcttaagtggtggacatgatggtagccgatattgcccgtcagccattgcaaaagcttcggcagcttgtaaaaggagcttccttctaccgcggcctgcacataatcccaatgctcatcagcttcaaaataagaatcctcaaacgtgtgctgaacataaaagagccagacgccgattgaccccgaaataaggaaaatcggaccctgaacaagcaaaaagttttcccagccgacaagcaggcacgtcgcagcagccaataagacaatcgccgcgttcgtgaaataggtgttccagcgctccttgcggcgggcgccttttacattgaaacggtttttaatcagaaatacgtaaatcggaccgagaataaacataataaacggattgcgataaagtctgtagcgtatttttgtccaggctgacgcttcgttgtattccttgacggtcatcatccaaatatcgccggtgccccgtttatctaagttgctgctcgtcgcatgatgaatggagtggcttcgctgccattgaaggaacggaaacagtgtcagaacacctgaaataaacccgaacagccggttcagcttcttttgtttgaaaaaggattgatggcagcagtcgtggaaaataataaagattcttgtcaaaaatcccgctgctataacagtacaggcgagggtcagaagataggagatattgaggctgaagtaagcaagaaaccaaagggcaaaaaacggcacaaacgtgttgaaaagctgaatgatactatgctttgtatcggcgccggaaaatgcggcaacctgcttttttaaagacgcttgtttttgagttgcggcgtgattgatcatgaatgtcatgtcccttctttttcattatgatcccaagtataacggggcgccagacgcttttgtagtagcagccatcatgccccgaatatgacatttgtcatgtttggcggcagaatgctgatcaggcgccatatggaaggtttctttcatatcggcacttctcaaagaaaacagcaaaaaagaacccggcctgttttcggccgagttctttttcatcatcctcacagcaaaatcacccgatacttctttacatccaaaaactgcagaaactcccgggccagcatatccggcgcgtggtcttttccttcatgaagacgatattgaatcaggccgacgagcatggacgcgacatagtatgcatagagctttttgcccgcctgaatgtgcagaggctgatgaagataaaacgattgcagcgctctgaacatttccgggatgacgtcaggcacttcggaaccctctctcagaaaatgaacgagcggaaggccgtccgacagtgccgaaaagagacggacgagcgcggcttccgcttcttccacggagcagtcggcagggtctccttttaccgtcaataatccgatcagatcccggcatgattgatggatgatcgttttcagcaatgcttctttgttggcgtaatggtcataaaaagtggcacggcggaggttgctttgacgggcaatatcggaaatcgtaatcgccgcgtactcttttttttccgccattaagccgatcatggcttcttgcaaggcctgcctcgtccttgtcacccggcggtcggcgggctttttttcttcttgttccggcacccggcggccgaacagccagtaaaaccgtttttgagaaatcaaatcccacacctgtccgctgatttcttccggggatgccccgggctcctcattcagccagtacaacacaatggcatacgtgtataacgcgcggtaatgaatgtacatatcctgttcagtcggtgagaaatccgcattgaccggtgacagcagcacatcatgccggaacacatcttttaaaaaagcatgaaagtgaaaatacggcattttatgacggtccatcatcgtttgaaaaaacacccgatgccggtcaacaaaagacagtgtcggatgcactttttgccatccgccctgtaaatgaagcacatctttattcttcagcgaatcatacagcgcttcgctcagcccgtctttcatttcttcctctatatcctctaaaatcgcatatttatcttcgtaataaaggtacagtgtcccccggctcacgtgcgcccgtccggcgatgtccttcatggtcacacggcggatatcccgctctccaagcatggccaaaagcgcttgtttgatgtcatttgtcacagaatccggcataagagacactcctttcattagacagatcacggcaatttgtacggtaacgtatagatgcgtttacgctgtctttgccgcaaaatcacatcacattataataggccctgaagaaacaaaaaagcaaccagaggaggaagaccgatggatcagcatataaaagcagacatcaaacgcgtctttgcgcttcagaaaaaaaatcaaaaaacgctgcgtgcttcaacagccgggcagcgcagagaaaagcttcagcgctttttagatgccgtcaccgcacatgaagaagaaatcatcgaggcgatcagacgggacgtccgcaagccttatcatgaggtgaaaagagcggaaacgcagggaacaatcaaggcgattaaagataatatgaacaatctcgacacctggatggcgccgaaacgcgtcggctcatccgtcagccccgatgctgacggcgtattaatgtacgagccaaaaggccttaccttaattctcggcccatggaattatccgtttatgctgacgatggctccgcttgcggctgccattgcggcgggaaacagcgcgattgtgaagctgtccgattttacgatggagacgagccatatcgccgcgacagttattcgcgaggcatttcacgaagaagaagtcgccatttttgaaggtgaggtcgatgtcgcgacagaactgctcgaccagccgtttgaccacattttcttcaccggaagcacaaatgtcggtaaaatcgtcatgacggcagcggcgaagcatttgtcgtccgtcacgcttgagcttggcggaaagagcccgacgatcatcgacagcggctatgatttgatggacgcggcgaaaaaaatcgccgtcggcaaatttgtcaatgcggggcaaacatgtatcgctcctgactatctccttatgaaggaagatgtacaggacacctttacagatcttctccagaccattgtcaatgcaggttttatggaggatgatcatacggttgaccgcaacaaattcacgcagattgtcaacgaccgcaactttaaccgtgtcaaagccctgtatgatgatgccattgaaaaaggggcgaaaacggcgttcggcggcgtattcgatgcgcatgaccgcacgatttctccgaccgtgctgacaaacgtcacgcctgatatgaagatcatgcaggaagaaatcttcgcaccgattctgccgattatgaattacgaagatatcagtgaagccgttgattacatcactgaacgggacaagccgcttgccttgtatgtattcagccataatcaggagctgatcgattatgttctgcagcatacgacgtccggcaacgcttctgtcaatgatgtcgtcgttcatttcactgacgtcaaccttccgttcggcggtgtcaatacgagcgggatcggttcatatcacggtgtgtacggctttaaagaattctctcatgaaaaaggcgtatttattcaagcctctaaataaaaaagaatccgcgcacgcggattcttttttattatttttttgccccgaatgcgagcagtttcgtataagtaccgacataaagcgtgccgtcttcagccagaaccggggaggaaatgacattgctgtctgtttgatagcgccatttttcattaccgtcagcgtcaaccgcatagacatttttatcgtcagaaccgaagtacacattgccgtccgcatcaatcagcggcgccgttctcacaggcccgtccgtatagaaagaccagttcatattaccggttttgctgatggaaaacagctcgccgcttcccgaaccgatatacacattgccgttatggtcgatcgctaatgaagagctggagaaaccgtttaacgggaacgtccactttacagcacccgttgatgtataggcgtataagttgccgtcctgatttccggcgtaaacggtgccgtctctatcaataaccggataacctttaaacccgttggacgtcgtttttgaccatttcacttggcccgttccggaattgatcgcgtaaaagatattattgtacgttgccgtatacagagtgccgtttgatgctaacacgggagcggaaccgaccacgccgtttgttttaaacttccacttctgcgtccatgtcgaaggcgacgtcggtttaatcgcatagatatagttatccagcgtcgacacatacagcgtgccgtcagagccgatagccgcatcggaactcggcgctccgctcagcggaaccgatgttaaaatgtttccggtttctttgtcgatgaaatacagttttttatcgtgagaaggaagataaatgacaccgtttgttccgagcaccggagtcagcgtataggtcgtcccgaggttttccgtcacccatttcacagtaccgtccgaatgatacgccgtcagcttcccgtcctttgattgaataaatacggtgccgtccccgtcaaccgcggctcccgcaccgttttgaggggtggccggaacattcttttcccattttaacgcgccatcggcagtgcttgtaaaccggctttctcttgaccagttgaacatcgtcggagacatcgcctgcgcgtcataccgtcccgccaagaaaccggatgccgcatgattttgtttaaataccgtttccgcagcttgagcagcggccggatgcagccattttgcccccggcagatcagaaaccgcccccacagataaagccgcagcaaccgcagcgccggccgccaatgttttcattcgcaatgaagctgtcttttttttcaatgtcagttcctcccgtttctattaaaaactgctataccgctttcatcataccataatcatcctatgaaatatttgtattttcggtagatttatagaacaaatgtcacatagcctgctgatgcttcggggaggaacgaaacgcggcaatataccacaccacattgacgatgaaagccgcgcctgaccaaacgaaaaggccgtaataaagagacagctcttgccctaaggaaattgcggtcaataacgccaccaacaagacagccgcgcaaatgataagcccgattccgcaaaaaacggccatgatgattttcatgccacgaacaccgagaatatacataatgagcgggaccgcatatataacaaggatctgaccgacggcggcccacatgcccgcggaattaaaacgattcgcgttcggccccgtttctgcaagcggagaaagcgatacgaggaccggcaataaacaaaacatcagagcggaaagcaaggtcaccgcaaccgcaccttttttcttttgattcatgtgaatatcctcctgacaataacccggcttttttaccggtaatctgataatatgttatattttagcacgatatttagttattttgagaatgttttgttaaaaacgaatttacaaatccagaaaaatagatataataaacgttatggaaccgatattgattcataaagcgttatctaacaaaacacgaagtgatattatgacgtggcttaaacacccggaagaccattttgatgaaaggccttatcttgagcagggactcagtttccgcaccggaatttgcgtcggtgatattcaggcaaagtcggggcttgcgcagtccgtcatctccagctacctgctgaccatgcaaaaagccggcctgctggaatccgaacgaatcggaaaatggacctattacagaagaaatgaaaaacaaattaaagcctttgctgactatgtccagcaccagctataaccatgaaaggagggctttttttgttctaacatatctatttttctatatatgtagttataaaaggaggcatacataacaatgaaaaaaagcagttccatcttcattctatttttggcactaggggttttcgggattattacgaccgagatgggcatcatcggggttcttccgcaagtggcggacagatttcatatttctgcttcaaaagcgggatggcttgtcagtattttcgcgttcatcgtcgctgtgtcgggaccgtttttgaccttgcttgcttcaggtataaaccggaaatacattctgcttttagcggtgctgatgtttgccgtttcaaatgcggtctacgcgtatacggcgcatttcagtgtcatgctggcgtttcggatcattccggctttatgccacccggtgttcttttctgtagcgcttgcggccgcggcccggcttgtccccgccggccaatccggaaaagccgtaacgaaagtcttttcaggcatcaccgccggctttgcgttcggcgtgcctttcacgtcctatctggcggagcgtctctcccttgaatccgccttcttattcggcgctatcatcagtctcatcgcgttcacgggcattcttctctttttgccatccatgccggtcacagaaaaaatgtctttcagtagccagctcggcattcttcgcaaaccggctttgtggctcaatatcgctgccgtcacctgtctctttgcggccatgttttctgtctacagctattttgcggagtacctcgggcgggtgtcccatatgaacggcacatgggtcagcttcatgctgatgagtttcggggtgattatgatagccgggaatttcgtcttcggtgctttgttatataaaaatatgaaaaagaccgtcatcctgtttccgcttctttatacagccgcctacttgctcatatacgggtttgggacgtctttcgcgccgatggctgtcctcgtcttcgtatggggcgccgttcattccggcggtctcattgtcagccagacatggcttactgcggaagcaaaggaggcgcctgaattcggcaacagcctgtttgtctctttttccaacctcggcatcaccatcggaacggcggcgggcggctggtttatttcacatttgggaatccatcagctgatgtggtgcggcatcatgtttgcccttctggctttcgggctgatcatgggacgcttggcatggggaaagaggctgctcgcagaagcctaagctccgttgcaaaatccggaatgattacgtataatattccagattaaagcaagggagagaaaaagatacatggaaagaccggcaggattttggattcggtttctggcttacgtcattgatcaaatcatcataggaattccgatttttatcattcaatttatggtctcttttttatttgcggcaggcgttgcggcggctgaccccttcatgaccgaaaaccagtttaacatctcttttctggtgttcggcgtcattccgattcttgtgagctctattgtgatcagcatcttatatttcagcctgctcacagcctcaaagatgcaggggaccctgggaaaagcattgctcggccttaaggtcgtcaatgaagatggcggacgcatttccatcggccaggccttcggacgcgctttcgcatatatcatatctaagctcattctttatatcggattcatcatgggtgccttcggagagaaaaaaacgctgcacgacatcatgtgcagcacccgggttgtttataaataatgtccccaagtccgggcctttgagcccgggcttttttatgacggctgtgcccgcctgatgtcaatgccgccttctccgtcagcctcaatgcggatcgtcccgttcacaatgacagacagccgatggaactccgcatgctgatcagaaaaaatccagcggcggccgctcggccctaaaagtaaaaacgccccatcattgtaatcacccataaaatgaaacccgttttcactaagaggcgcatgctttctcaccggaatgccgaaacgctgcagctccttccccgtcgataccacctcggcagccgtcagattcacctcgccgatattcaggacggacccaatcgaaaaacgttccgcgctttccggcgatgtgtctctcgcgatgaattccgccaggttgttggacggatctttgaaataaaaggaacgcgcctgaatatgagagaaatacacctcatcctccccatcttccgtttgaaaaacgactttatcctttatccacgccttcgcctcatcaaaacgattattcggaatattaaacgcgaaatgatacgtcggatgagagtgagaatcggcgcgcctgaattccaactcactttcccccgccttgatggtaaacgaatcaccggactcatcaattaaaggaaaacctaacactcgttcatagaagtgtttcgtctcctccaacgcacaactgtacaaagtaatgtgatttatttgcatgatcataccccctttggtttatactgccatatagaggggttgattcctactgtttgcttccttaaatatttaacagttaagcagattacatatattaaatggtttatctaattaactttaattcaatgattcatcgtggcagttatttggggtataagctctcttctcttatcgaaataatttgtgtaatctgattcacctgaatatgtaatgcaaagatattgctttgatcgagtcatgccgatatacataagaggcacttcacggtccttatctttttctttttctaatggcatgagatctgctttaacaataaaaaccgcctgaaaatcaagtcctttactgctgtcgattgtagttattttcactgtttgttcttcaggattaaaattccgcttcgaatccttactttctgtaatccaataaaaaggaataccatactcgtccagcgtatgtttaatacatgcaactacccccttcaaattcgctcgatacaagatagcaatttcggaataaggaattttcttttccgcatgaaagttcaaaatttgtttcgcaacaatccttatctcatcttcaatattgtcacaccttataagagctgcttcaggacccttacgttttgtacttttgggtgagataatttctatatgttctccttcttgctgtccttttttttgcatatcggcgaatgtttcataaaaatcccatgcaagtgaaacaatttgtgccgtattcctataattgatattcagaatttttgatctccctctaaaatcaaaacctgtttctttgatataactcctcttattaccatagatcgactgcgctcgatcttcgaccaacaataatgactgcgtatccggatttaaacaaaggctgactaatttaagccagttcccttcaaaatcctgaccttcatctatcaatattgcatcatactttggcaatactttttccgctatttcaatattctctatataatcatctacattattaatttgcagatcttgtttaaaccattggtgaaaatttcgaacatgtaaattatccggcacttctgcttgcagagcatcgtggtcctctgagtaagtatcacatactttttccggctccgcgtacatagaccgcaccatttgaatgatatttcgagacaaagaaatattaaagcagagtatcaaaatgttccaatcaggatgtttcttcgcaagcatttttgcacgactggctaatattaatgtttttccgcttcccgccacaccacggatcagcctatgtttgtcaccaatctgcttcgccatgttttcttgatgtaagtccatcgtttttatatctcgcagtgacagcagcagctgatcccgatacggaacggtttccttcacttcagcaccaagacggatttccggaaacaaataataacgaatcgtgttaatttcctcatgtgttaaaggctctttaagacggaaaggaactttgaacatctgaactaatttctcaaccattacatctcctgaaaaatgttcatggtcaggatcgatttgatcccgtgaaagaataaattcaggatcaattacatcataaactctgctttctaacagttggatttcactcaaacgtgtaaacaccaccccgtatccataaggaaacttaagcttaaactggtattttccttctgtctgtattaaattcttatctttttctaacatctcaacaactttaaaagaattatctcgggcttgtttgaaagggtttttcacactatgtaaatcaccttgtgtgcttcgtattgtccattgttctctagtaaaatgataaaatgtatttttagtataatcttttacttcaagtacgatcagacctaaatctggaccaataatgataaaatcgggtcttacaccatgaatttccggctcgtaatacactatataatcatcaggaagccaatcttttaatgtacgaaacagaattcgttctcctgatgtggctgtacttttaattgattctggtattgttattgccaccttttcagctcctttatattttttccatctattcaaatggcagttaactttataaagacaatgaatacatcaatattcttgtctgactccgttcagaaatgattcaatattctcaattcggtaagcagtatagggatgagttgaagctaataaagcgataaaaccttttcgaacgtcaatattttcacgttcaagccgatagaaaaattctaacagctcatctccgaaacccgctttcgctgctacttcatctgcccgatattcaaaatctctgcttccgatattcacaaaataaaaccccaaacggcagtacgttatgtaacaccatccgaccagcctgaagaatatgtttaataatcccccagacacagaaggatttgatccgccgttcagaagcccttcaatacaccccagaataaaacatataaagaatcccatcacatacagcggcaacagtgcgatactcaaaatagtaaaactggaattaaacatcacaaggtgtaatgtgtctttaaaagcaagatgcgcatactcatgggccagtaccgcttttagctcaccatcacttaaatttctcatagccgccgaagtcagtcctatcgttttaaaccccagtgcaaatgcattaataccctcatcatctattaaaaaaagatccgcttttttcacatgagggtaatgtctttgtacgcttacaaaaacttcatcgtttaacctttcaaggtactccttttctccaatggttgccgggcgccttaacccagccctgattctatttctccaatccccaaaaagtccataattcataaagaataacaatccgtaaacggataaaaaaagaagaaccgttggaaaaagtgccaaaggaaataattttctgaagatcataattgaaatcaaaactgtcagcccagaccaaacaatgtataaataattgaactttgtttttctaacttccatttttgatcacccttttttattatgtttgaatgatttaccgctacttaaactgtctttttattatcggtttcgaaaatagcattgtaaagatgattatccattttttcccgaaaaagaggtgctgtttttaacagcacctctttttaatcactcttcaaaataatccaggtcaactctcttgataacaaaagtattctctaaactaacgccgacattatagttgaacatcaaatccgttagcctctctccatcaattaatataatttttttatcgatcactttaacatattcttttgcgccatcagtaaatacagatgtagtaataaacacaccctttttcgcttttttcccatccaggctgcccgcaaatttttgtatttccggccttgaaacagaatctttccacctcttggcttgaagataaatcatatccagccctaaaatgtcttcttttataactccatctatgccgccatctccagatctccctatagccgtgcctgcatctgttaacgaaccgccatatccaagagcaacaagcaattctacgactagtttttcaaaaaaagcaggagaacatttgtatatttggttcagtaactcttctttaatctcatttttaacagcattataattatgttcaatgatttcattgggagttctgggctctgaagtaaccgccggctcactttcctgttgattgctgtctttacccgtctgtttgaatctctgaaagctcttatatttcattagaaatctattatctatactggcgacactcgggtcattaatgatttctaagccttcgctggtgatctgaaaaacaccccgtctgacaatgtcgattaaaccggctttacttaaataagttcttacccaaccgattcgattatgaagtactttttggtttccgctgggtaataatttttctgcatcttcctctgacaggtttaactcttttgctaatttcacgtataattcttgtaatctgtgctcctttttatctgaaagaatctttaaaaaagggtacataaattcttgatatcctggtatggtcaacttctacactcctatttaacgtctttgttaaaactggcttgatatttatattatttttgcgtccctaacacccctgcgtaaaaccatcttcatttcacacctaaaatctctttcagaaaatcactcatgatgatatatgagtaaggctagtataagaacatccgcaaatatatactttaaattctggacaccggactgatcatttttttaaaacctaacgcccgttcataaaagtgtgcctgaacaaagttactttatttgcatgaccgtcccctctttggtttatactaccatatagagggtggattcttgatattattctgcaccaattgagaatccccctttcgcccggcgctacacatgacaaacagcgccaaaccgcttataccaggcgtttttaaatgtctaaagcaaaaaaagcagaaaataataccccatatagcttgacaaaaaataaatgttatttaataatctatatataattagaattattattgaaagataaagtgaatgctttgtctttttaatatatttcaaatcacatttcaggaggaagatattatgtctttaatcggaaaagaagtactgccattcgaagcaaaagctttcaaaaacggtgaattcatcgatgtaacaaacgaagatttgaaaggtcaatggagcgttttctgcttctacccagcggatttctctttcgtttgcccgactgaacttgaagatcttcaaggacaatacgctgcactgaaagaattaggtgttgaagtatactctgtttctacagatactcacttcgtacacaaaggctggcatgacagctctgaaaaaatcggcaaaatcacttacgcaatgatcggtgacccatctcaaacgatctcccgcaacttcgacgttcttgacgaagaaactggtcttgctgaccgcggaacattcatcatcgatcctgatggcgttatccaaacagttgaaatcaatgcaggcggtatcggccgtgacgcaagcaacctagtaaacaaagtaaaagcagctcaatacgttcgtcaaaacccaggtgaagtctgcccggctaaatgggaagaaggcggcgaaacacttacacctagccttgatttggtaggtaaaatctaaggagtgcattccattggtacttgatgcaaatatcaaagcacaattaaatcaatacatgcagctaattgagaacgacattgttctcaaagtaagcgccggtgacgatgacatttctaaggacatgctggctctcgttgacgaactggcttccatgtcatctaaaatttcagttgaaaaaactgaattaaacagaacaccgagcttcagcgttaatcgtaccggagaagacacaggcgttacattcgccggtgttcctctcggccacgaatttacatcattagtgctggcattgcttcaagtcagcggcagagcgcctaaggctgatcaaaaggtcattgaccagattaagaacatcagcggagaataccgctttgagtcttatatcagcctgacgtgccacaactgccctgatgtcgtccaagcattaaacatgatgagcgtgctcaacccgaatatcacacatacaatgattgacggcgcggcattcaaagaagaagtagaaagcaaaaacatcatggctgttccgactgttttcttaaacgatgaatctttcggcagcggccgtatgaccatcgaagagattctcgcgaaaatgggcagcggcgcagatgcgtctgagtttgccgacaaagagccgtttgacgttcttgttgtcggcggcggacctgccggcgcaagcgcggcgatctacacggcgcgtaaaggcatccgcaccggtgtcgtcgctgaacgcttcggcggccaggtactcgacaccatgagcatcgaaaacttcatcagcgtcaaagcgactgaaggaccgaagctcgctgcaagccttgaagagcacgtgaaagattatgatattgacgtcatgaaccttcagcgcgcgaaacgccttgagaaaaaagacctcttcgaacttgaacttgaaaacggcgctgtactgaaaagtaaaacagtgatcctttcaacaggtgcccgctggcgcaatgtcaacgtacctggtgagcaagagttcaaaaacaaaggtgttgcatactgtccgcactgtgacggacctttatttgaaggcaaagacgtagccgttatcggcggcggaaactccggaatcgaagcggcgattgaccttgcaggtatcgtcaatcacgtgactgtgctggaattcgcgcctgaactgaaagcagacgaagtcctgcaaaaacgtctttacagcctgccaaacgtcactgtgcacaaaaatgcacaaacgaaagaaatcacaggcgaccaaaacgtaaacggcattacgttcgttgaccgtgaaacaggcgaagaaaaacacgttgaactccaaggtgtattcgtccaaatcggtctcgtgcctaatacagaatggttagacgaaaccgtcgaacgcaaccgcatcggcgaaatcatcgtcgataagagcggcgcgacaagcgttcccggcctatttgccgcaggggactgcacagacggcccgtacaaccaaatcattatctccatgggatcaggtgcaactgccgctttaggcgcatttgattatttgatccggaattaatgtaaaaagcgctaccctgcttacaaggcaggatagcgcttttttatattaaaacggcatactgcatggcagtacaccgtctgaagtaattcaatctgtctttctccctctcgcccgatagatgagaaataatccaataaaccacagcggcgtcagcagcaaagccgggcgcgtcgcaaccgcaaacagcataatcaccagaatgacggcaaacagcgccagcacggcgtaattgataaacggcgcaaacggcgccttgaaagacgagcttgcatgtaagtccggacgggttttcctgtatctgatatgacagacaagaatcacgccccacacccaaatgaaacagatcgcgctgatggtggtcacgatgccaaaggccgcttccggtatcaatttgcttaaaagagcgcccgctgacagcacaataaccgatatccataacgcgcggctcggcacatgatttttattcagcttcgcaaaacttgccggcgcctgtttcgttttgcttaagttatacagaatccggcttgttgaaaacatcccgctgttacaagcagaagcggcagacgttaatacgacaaaattaatgattcccgcggctaacggaatgccgaccagactgaaggtctttacaaaaggactttccgttgcattcagctgcatccacgggttaatacataaaagaatgatcaatgccccgacgtagaaaaataaaatccgcaatggaattttattgatcgcggacggaatattttttttcggatttgacgtttcagccgccgacacacccactaattccacaccgacataggcgaagatcaccatctggaacgaaagtaaaaagcctgaaaatccgttcggaaacaagccgccgtgctcccacagattcgccgctgaaaccgttccggtatgcgttttgaacccaatcaccagcagaaccaccccgatgacaattaacgcgagaatcgtgactaccttaattaaggcgaaccaaaactccaattctccaaaaatcttaaccgttaacagattaagccctaataaaatgagcaaacagataagtgccggaatccactgcggaatatcaaaccaatatttcacatacacaccgacggcgatcacatccgccatagccgtcataatccagcaaaaccaataggtccagccggtgacaaacgctgcacgcggtcctaaatgcgcctcggctatatccgttaatgattggtaccccgctttagataacagcagttctcccagcgcccgcatgacgaaaaaaagcgcaatacctacaataaaatacgcaaagatgatagaaggacccgccagctgaatcgccttaccggaccctaaaaacaatccggtgccgatcgtgccgccaatggcgatcagctgcacatgccgattcgataagtccctctttagctctcgctgctccacatctgactcctccttacctctctagtgaacgacgagcaaaaaaagccaataaaaaaagagattggatgccctccaatctcatggtcataagaatatcaaattatatttgcgccgctgacaatcaacagcatgacaaatacatattcggtactcttctgtccttttgcctgagattgtgaacccttcggcgccgcggaaaacccgcggtctctccagaagccgctcctgctgtagtgcgacccacagcaatcatagcctgctacgtattaagtttccgatagaaataactatcagctaactttttattttaatggaagttgaattcattgtcaatagggggatgtgctcacggcgttatcccggtccaatttcgatgcctgaagcgccgtattttccgttttcattgtctcaaaaaggcgttatgcggtactatcatataaggtctaatgatgtaaacattatgtcatactttaaattcactttatcatacaattgctcgtaaataaaaaggggatggacgagattggaaaccaaatatttagatctgctcgcacaaaaatacgattgtgaagaaaaagtggtcacggaaatcattaatctgaaagcgatactgaacctgccgaaaggaaccgagcatttcgtcagtgatctgcacggggagtaccaggcattccagcacgtgctgcggaacggttcaggaagagtaaaagagaagatccgcgatattttcagcggcgtcatttacgatagagaaattgatgaattggcggctttggtctattacccggaagacaaactgaagttgatcaaacatggctttgatacgaaagaggcattaaacgagtggtataaagaaacgattcatcggatgattaagctcgtttcttattgttcttccaagtacacccgatccaaattgcgcaaagcactgcccgcccaatttgcttatatttccgaagagctgctgtacaaaacagaacaagccgccaacaaggaacaatactactccgaaatcatagaacagatcattgcgctcggccaggccgataagctgatcaccggtcttgcctacagcacgcagcgattggtggtcgaccatctgcatgtggtcggcgatatttacgaccgcggaccgcagccggataaaatcatggaagaactgatcaactatcattcagtggatattcaatgggggaatcatgatgttctctggataggcgcttattccggctcaaaagtatgcctggcaaatattatccgcatctgtgcccgctatgacaatctggatattattgaagacgtttacggcatcaatctgagaccgctattgaaccttgccgaaaaatattacgatgataacccgtctttccgcccgaaagcggacgaaaacagaccggaagatgagattaaacaaatcacaaaaattcatcaggcgatcgcgatgattcaattcaagcttgagagcccgattattaagagacggccgaactttaatatggaagaacggctgttactggaaaagattgattatgaccgcaatgaaattacgctgaacggaaaaacgtatcaactggaaaacacctgctttgcgacggtaaatcccaaacagcctgacgagctgctagaagaagaagcagaagtcatggacaagctgctgttttctgtccagcactccgaaaagctgggccgccatatgaattttatgatgaaaaaaggcagcctgtatctgaaatataacggcaacctgttgattcacggctgtattcccgtcgatgaaaacggcagcatggaaacgatgatgatagaggataaagcttatgcgggccgtgagctgctcgatgtatttgaacggttcttacgtgaagcctttgcccatccggaagaaaccgatgatctggcgacagatatgacgtggtacttatggacaggcgaatactcctccctcttcggaaaacgggccatgacaacctttgagcggtatttcattaaagagaaggaaacgcataaagaaaagaaaaacccgtattactatttgcgtgaagacgaggcaacctgccgaaacatcctgaaggaattcggcctcaatccggatcacggccatatcatcaacggccatacaccggtaaaagaaatcgaaggcgaagatccgatcaaggcaaacggaaaaatgatcgtcatcgacggcggcttctccaaagcctaccaatccacaacaggcatcgccggctacacgctcttatacaactcctacggcatgcagctcgtcgcccataaacactttaactccaaggccgaagtgctgagcaccggaaccgacgtcttaacagtgaaacgattagtcgacaaagagcttgagcgaaagaaagtgaaagaaacaaacgtcggtgaagaactgctgaaagaagtggcgattttggagaaactgcgggagtatcggtatatgaagtgaagaatatggagttcagagatgattctctgggctctttttttacggttgcgaactaagaagtccctttccctgtatgtaaaacggatttaaccgcttcttcaatctccctgtaacccgtacatctgcaaatattggactccagccaattttttatcgtgtcatcacttgcattcggctcagtattcactaaagcgtggcaattcatgagaaaacccggtgtgcaataaccgcattgaaacgcgaatttttcaataaaagccttttgaatcggcgtattgatcagtccttcaattgtcgtaatgtcctttccttccccttctgccgcaagcattaagcaagacttcatcggcaccccgtccgttaataccgtacaggcgccgcaatccccatttaagcagcccggttttgcaccagttaatccgagacgaagacgaagagcaaataacaaagtatcagccggtctgaccgtaatctgtctttcctcgccatttactttcaacgtaataggatcagacatttggacctccttctaattcctgtaaggcatctaaaattgtatgttgcaagacaaatattcggtattcacttgagccttccgcatcatcaagaacgggtttgggtacatactgtaaagacctgcgcactctatcttctaatgaatagcttttatcgttaagcacagcctccatttcagcagaacgaaacggaaatggacatacgccgctgaaggccattctgatctcatcatcttttttcagcgcacagactgtcaccaatggatatccgacattccactgctgtcttcttttgatactgacaaacggctggtcaacatacgctcgatcgacaacgatatgaaataaaatatcacctttttgcaattgtatttccttgttaaatactttatttatggggcggtaatgaatccccgctctccctgcaatccctagcaaactatcagaaatcagcaacggcagcacggcctcacggtaatagatgcccccgcaaatgtttccgcccaggctgattttatttcgagacgtccgatccgcaatttcacttaccgttttacttaaaagcggaaatggattttcttcctccagtttcgttaatgacacgcccgctccgatcaccagataacgttcataaaaacggatagcgtgaaattccggaagcgcgttcatatctatcaccgtatccgtatagacgatattcagccttcctaacgtgataatttccgtcccgccggaataatacattggtgttttcttttcggccgcaagagagtgaaatagattgattgtttcttgaatggtcttcggtttaaaatagtcaaaatcaaacggtatcatctttccacccctcttgcgttctccataattgttcgggaatgagaggaagttgattcaattggacatctaaagcggcggaaaggcaatttcccaatgcggccggcatccccagcagtccgtgttcccctccgccgcgcgctccataaggcgcaatcacatgcggggtttcaacaaattcaacgatatattcaggctgctctccatagtgaagggggcggtatgttctaagctgaggatttaatactctgccatacggatcaaatacaaaggtttctcttcctccgaatgcgattcccatactcatccccccatcacttgaccccttgcagctttttcattcaatactgttcctatatccacaacagaataggcttttgtaattcggtacgtataatcccgtttatccaactcaacttcaatcccctgagcaccgacagcccactcgggtcccggctttcctcttcccgtttcccggtctaaattcgtcatccgggttagtgtataattgccgctcgcaatgatttggccgccaatggtatttccattcggaaacgtatatccgtaagcaatgtcttttatgtcaacatgtacagaaggatgatctataaaataaacctttccgtcggccacttccaattcctcgacaggaacccgcaacacacatgatgccgcgtccttaagctttcgaatggcttcctccgctgcattcagtacggctctcccagccattaacgtccctctgctccctacggttttccaatgctcgggtgttgtttgtgtatctacaagcatttttacgtgaattttgcttatatccattttcattcgttccgctaagatttgggctagcactgtttttgtccctgttccaatttccactacccctgacatcaaattaatgcttccatcgggattaaaggttaaaagaaccccggatgttgcatttgtatcaaatgttgaggttttccaaatacagctgattcccttcgcccgtatcttccggccgtcgatttcaattcgctgtccctcgtcccaattcattaattccttcaatctttcaatacatttcggtacatttccgaccgtgcttgaattgagaagaacttgagtcggtgtggtatcaccggggcgaatggcatttttatagcgaagttctaacgggtccatgttcagcttttccgccaatacatccatcgtccgctcaaaagcaaataacacttcagcatggctgtagcccctgaatgcacttggatatgggtgattcgtatacatacaatatgaatcacacgatatatggtcgatagcgtacggacccgtacaatcaaccaccgcagcccggctgatgtccactcctttatcagagtatgctccgccatcaaataaaagctgaatgtccgccgcctttaaaattccattctttgtggcccctaatttgacaatggcatccaatcctacatgaacgggagatgtgatcatatcctcttctctcgtattaaacaatttgacgggccggcctccgactgcttttgatgccaaataggcaatcacctctaactgaacggctgcttttcccccgtacgctcctcctactaaaggcgttttgacgatcacctttccgggttcaattccaaaataccactgcattaattttttaatggcaaaaggagcttgagaggatgtggtaatgataatctcctcatccgcccgaatttcaacaatcgagcatcttgtttccatcgcagcgtgatcagaagggttaaaggaaatctggaattctgctgtcacatcactttccctaaacccgtcttcaatatttccttttctaaccttatccaggtttgcgatatttgtcttcggaaccgggaatacaccttttgtcttctcatagcggtccgcatgttcatgaacgagcggcgcatccttttgaaaggcctcacggggggaattgacgacgggaagaggtttataggatactttgatggcatccgcggcctttttagctgtaatcggattttccgcaacaacaacagcaaccggctcaccatggtatctgacccttttgtaagcaatcggcgatctgtctttaatttcctcacctgcaagcggaaaaggttcatcccccaatatcgctctcacaccgggaatcttccaagcttctgaaaagtccatcgacacaatatcggcatgagcatatggactggtcagcatttttgcgtgcaacgtccctgtttcttgaaaatcatccgtatatttcgctttacccgtcactttttcaagggcctctttccgaatgacactcttcccgatatactccaactcattcactccccgaatttattcagcagcagcctataatcttcaactgtatcgacgtcataaaaaagcaaagggtcttgaaagctgatcatttttcccgccttgatcatactttcacggatgacatgccgggcgccctgatctccctttaattgatacaagactggaaaacattgattggagaataaaatgggaggcataggaagatgctgattttcagcggcgataaatgaataacggcgctctttttgataggaatcaattaacgtattgatgatatctgcggtgacaaacggctgatctgcaaggagaatgataacggcgtcagcctcgtacgctgccgctttttgtaaaccgcatattatagaatggctttggcccttacccgcctgctcacattctgcctggctccacttatttgacataggggataaaaagaaaaattccgaaagccaatgcagtgaatctccctttcccgtaataacgaaaatatgatctaattcagataacaaggcatgtttaagagccatacttccaagggaaacgccattgagaaataaacttcgcttatccgtccccatgcgtctgcttgtaccggctgccaggtaaatggctgctgttttcataagcgggacctttgttttcgcatttctttaatcagctcgccgacgatacttacagcaatctcttcagggccttgtgccccgatgggaaggccgataggggaatgaatatctgccggaatctctgccccgcctaacagccgctccgtacgccttctgggacctaatacgcctttataaaacacattctcgttttttaatgtatgtaaaatgatctgatctttttgaaagctgtgcgtcataatgacaacaaaatccctttttgtcatgctcaggccttccatgacttcttccggcgctcccgttatcaaatggccggcttcaggaaaatgcccgtgatgacataaggcgggacgccagtcaatcaccgtcacatgaaagcccgcacgagccgccaacgaaactaacggcctcgcatcttctcctgctccgaagacatataaacaaggttttggcaccatctgatggataaaaaacaaatcagatgtatgttcatctcttttgattcccttctctgtctgtctcagtttttgaatacagccttgctccatcacatccccggttccaaacacgctgccgtcttcagcgatatacagatcttccttcggctctaacgtttcagtgaatcgtttcactcgggtcacagatttttttccatctaagcatgtcttgactgtcatcagatgccgttccaattccccttttacaggctcaagcaacaccgtcaaaacaccattacagccaacgccctgtccccaggataaatcgtcttccgcactcatatcaaagcggacaatcaacggttctcccgcagaccagacctgctctgccctttcaacgagatcttcttccagacaaccggcggataacatgccgactcttgttttgtcctctaaaatcagcatggaggcgccttctttcttataagcggacccctctgttttaataatggtagccagtaccttagctttcttagaattagcgatgacatccaaaatccggtgtatatcatccatttcatgtcccccgttttacctgatcatatctgcatctgtatatccgtattctataattccagaaaacattacaaacgcttcagcaatttcttcgtttctaaaaaaaaagagtctttatagaccttatgaccgggcggcggttgcgacagcatgtcggagcggagagattccaataacacgttctgttccttctgtttccgattgtctgtttcgccctgctgtattcctttaaaacccgcaaaatattcacttaacacttgtaaattattccccagctcccttttgtcacttgaagataaagctccttctttttcccattcttttaacgttttcactatatttgatagatactcaaatccggcgttcaacttttgcatctctatttgatagcttgaaatgatgtttttatgtttttttctgacggggttgaattttaagctgtcagaggctgtttgcagcatctcttttgccgtatgcagctcctgcagaagatggttcattttatattccataaggttcccttttccttgtccccactctgattgcacccatttggaaaggtctgaaagtgcgtcggaaagctgacgggccaatgtttgaaaagagtccgctgccttttttgtgtagtccggcggaaacaggaacatgtgaatcagaatcgcgatgatgacgccgatcaccgtatcgatgattcggtcgaatgcataatctttagagtttcgttcaaacgtaaagaccaataaaatggtgagcgctacctgatgtaaaaccgttacatctattcgtaaccacttcgcaatgtaagtaccgcctaataggaacagccccagcatccagccattcattggcaagtgactgacaagaaaggacgttagcatgatcccaatcgcagttcccgcaatacgatgaaaagaaaagcgaatcgactgatctatcgttggctgcaaacataaaataacagacagaggcgctaaataggggtgatcagagcccgccagttttgccgcttcccaagaaaccgcagatgcaatcgccatcttccaaaccaaagatgttttgttttggattttttcacttttcatcatacgccccctcctttcagaaaccttttccactaggtttccgtgacggaaagggatttatactgtcgtagggaaaaagcgaaagaagtgttgttcgaagggggattcttgaatgacggattctatttggggttggggaaaccgttagccttcagaaacatgaggcgtaaggtttggctagaggagaatcctattccattaaaagaaagcgaagtaagatccgatcaaggcgaatggaaaaatgatcgtcatcgtcggctacacgctcttatacaactcctacggcatgtagctagttgccgataaacactttgactctaaggctagtgtgagtatcggttaacaatgaacgattagtagagtgaaagaaacgaatgtcgatgaaaaactgctgaagaaaatggctgttttggagagattgtgggagtatcagtatatgaagtgagttatatttatggtttagggatgatgatagtctcctctacagtaatacacttaatggaaaatatgttattttaggggtttttgaccaacttactttcgaatcgtgatcagagagctaattcagtaaactgaaaataataaggtaatcatatcattagaaaaaacttcttttcaatagaaaaagtaacaccatgactttcgaggcgtcaatttcaagccctcctgctacacaaacgccaaagcttatgttttgaataataatattatcaaagaaatcatttctccctagctttccattgcatatggaagagttagaattgaagattttttcttatttgtttctggatacagtccagtataataaaatagtgtcgttggtcttaaagctggactgccggctttctcaaaaatctctcatataatgagcagtctacagtttgttgcacaggctactagtttttttgatgttaaactggaaaagctggagaaggatgatattgacttaatcacaactcgatggctaaatggagaaggagagttatttaataagttgaataggtaattgttgttagcgaaaaatgactaattgtaacttgaaaagaataaaatttttagaccttatcaaaaacctcaccagctttgctcctgtactactgtaatactttaatcgtcatattatacagaataacagtactcacgtatttccccataggttaaagaattcctcttcatcctaatttaacacatcacacataaaaacaattgaattaggatataataaatgtaatatatattaactaaggagagctctttatgaaaaatataaaagtctcaattgaccaattgtatcttgacccaaacaattatcgtctgcatagccataatagatataccccaattcaagaatcaaaagttgacaaccccttagtacaaaagcgtgtacttgatatgatttgcggcgataatcgagaaggaataaaagatttattagttagtttcaaatctaatggttatttaaaaattgataacattctagtgaaacaaattgacgggaagcctgatcattatgttgttattgagggtaatagacgtattgccacattaaaatctttaaaatttgattatgaaaacggctatgatatagaaaatttagatcctgaacaatttaacaaccttgaagttatcttgtatgatacttttgatgaagaatcttatcttttattaatgggattaagacatgtaagtggtgttaagccatgggatgatttcgaacaagcagaattaatcatgaatttacaattaaattttggtatgtcccaacatgaaatttccaatagattagggatatcaagacaagaagttagaagaaagttgaattcatttaaggcaatggacatttatagaaatgatgatgaatacggagatagctttaatactgatatggctggtctattccatgaattaatgagccgtcctaacctccgaaactggcttggttggaatgaggaattaggtacatttacaaataaagttaatctaaatagatttttcagttggatttccgctgatgaaaacggaaaaagaatattgactaagcgggatcatattcgtgatttaaacaaaataatttttgataaagaagctttagaaataatggaagataccaaaaatttaggagaggcattagacagcagtagttacttaactaaggaagggtttaaaagaaatataaaaaatataaaaaacaatattagtcgaatttctattactgctcttatcgatatggatgagagtacaaaagaggatctagaaggcataattaaatctgtagaagcttttaaaaagtttttataataaaggatcaattgtatggatatcaatattatacgcaaggaagacacttttaagtctcttttagaaatattattccttcaatatcaacattataataaccttataacctttattgataataattacgaaacaaacgatcccttaacaatggctaaagactttgcagaagaactcagcttatatgagacagatattgaggaaattttttcaactaatatatttgatataaatagtgagacgttggatataaatttcaatactgatttacttaataatatatctaaagcgcttatagagattaaagcacttattcctcatgatttcgaaaaattatgtgccttatatataaaatttttaggcacaaccggaattccaaatatcaccaaacattcgcatgatcaggggattgactttgtgggcattgtagagagaaaagtacactctagattatttagttcaaaatcaaatataaataaaatttatttaataggtcaagcaaaacactatgatactgataaagtgaagtctaatgaaattagagaattagctggatctatttatcttctaaaaacaaaaggttttgctctaaaaaacgatccttatcctaacatttcaataaagagttttactcctatatatgtatattttataacatcttactacttttcagaagcagctaaaaggttatgcatacattcagatattatgccaatcgacagaattttattagctttaacttttgggctgaatagtgaataccatgatgttacaggtcatttttgtccctatacattaaaaaatgctctaagtaatataaactacttttaattatataaaacagtaaatttccaacgattattatggtttattcaccgttttatacaggattaacttaaaagaacgtctaacctagtctttcttttcaatagtttattttcactttaactcactcacttaagataaggcttactttaataggaataaatgaggtttatttattaatatttgaagctttagtcagaatagaaatttggttataaccccccctttgaatcaaggaaaaaagttaggtaaataaattcacctaacttttttcccttgtcaccctatatatagtaactcattatgaagttcttctttcgaaattttttctattctataatgtgataattgtaactctaataaatgatttactaaattattttcctttgtagattctatataatatttgaagactcttcttaatttgcttgaaaaatttagattgtattttcttttgaatactaaagccctaagcaagttaagctctacatgtgggttctcttctagactaatatccaactcagatttcatcaaagattcccttaataaatctgcatataagcaatttgagttaaaattatatactacgccgtctatgtttaagtaaacagaccttgctagattctcttcacttggtgttaaattagtgtttttaaatgcccatgtattatttaaatcccaaatatcaaaatcaacatccgagattttaaatttatacccaccaaatcgattcatcctatattcataatttttaataaaattatgaaactttagtttatcattaaactttattgcaatatcaaagtctctgggatattggtcattttttaaatatatatcccgaacagcaccaccaaaaaagagtaattctcctgtttccgctaatttttcaacaaattcaagggtttctgagtattttccaagcaaattaattaactctactttaacatttccttcaattttactcattataaaccctccttaccgttatggtaacttcactcctaataactcttgatgcaagttaactgcatatccgtcagtcataccagaaataaagtctgtaactaataataatctattgtatagtgtaagctctgaaaagtctacttcaggttttccagcttcagaaaaacgctgaatatgcctaaaattttctgaaattagatgtactaatttttcatgcttactttttgacttttctagcccattaacattagtcacagcttcaatgaatagtgataataagtcagaaataactctatctccaactagctctagagtcaaaacttccttattagaaaacacatatttaaatgctaaatttcttaaatcatcagctatttcatttgcagatgaagtagataataagtctccgtcaaattctccactcataatctgatgataatttgttttaaaactttctacaactgcaaaaatcatgataccctgaatagatactttaaaattttgaacatcaataagacttttattaggtaccttattctctattgcctgtcttctgtattcttctaattttttaaataccgattcatattttttattaaacttttctttaagtttcatgtattcttcttcccaagtaaatactccttttttaactgcatcctctatatctgcagttaaataagcaatatcatcagctgcctccaatatatatgtagcaggatgcctacaaataccaataccaaccttagaagataatttctcaaataaatccttttcagcataaaaataaccaaatttcttttttccttgtttggttacattatcatgatttgatgcccatggatatttcattaatgtggctagagttccatacgtaaaatttgcaccgaatggatcatttaaaaattgtaactttgataatatcctaattgcctgtgcattaccttcaaagtataaaaaatcatttttttgttgttcatccatttcaccaaatttttgttgtgctttttcaaaggaagtactattaaaccatttttcgaaccactttctaataatatcttctccatagtgaccaaaaggagggttaccaagatcatgtactaagcatgatacttctaccagagatgctaattcttttgccctttcgaaattaggaaatactttttcttcaatcaaccaacttcctatattccaagctagagaacgtcctaatgaggcgacttctaaagaatgggtaagtcttgttcgaataaagtcgttattctgtagtggaaacacttgagccttatcttgaagtcgccttaatgaggaagaataaattattctttcataatctttatcaaattcatttctatgtggcaaacttttccctaaggattccctctgtctttcagtatttaaaagttgatcccattctagcacaaaaattgctccttcctgtatggcgtaattttatattattttttaattaaattcctatattttacgcatataaaatcccttcacttatgataaggctccccacgattaatccgaaatgcccgataaatctgctccactaaaatcagccgcatgagctgatgaggaaatgtcattttcgaaaaagacagtttgtcgtctgcgcgcttcatgacggcgtcgcttaggccgagtgagccgccgatgacgaaggtgattttgctttttccatatgtcgccagcttatctattgtatcggccagttcttcggatgttttcatttttccttcgatggcgagggcgatgacgtgggtgtccgggctgattttggccaggatgcgttcgccttctttgtctttgacgattttcatgtcttggtcgctcaggttttccggagctttttcgtccgggagttcgataatgtcgatttttgcgtaggctgagagtcgttttttgtattcttcaatgccttgtttgaggtatttttcttttagttttccgatggtcacaatattgatattcacaggtcatccccactttagaaacaagttattcatatatattgtccacaattgtggatatcttttctgtattttgtgtaggatcattcgttccctactagatatgttgcagtgtccccacataattcacaggctgtggataaactgttagtatgttcgatttttctgatttcgggcggaagctcatgatcatctatgtacatgtccagcacggtttcgatatgttcttcacaagaataataagcggttttcattgttacatcctccggttttcttttgcgcgcggcaattgttctcttctcaatataacctatttatacacatgttagtagtgcttcgggctgagttttatccacaattcggcaaatcacgcgcaaaaagagccggtgttttcagcatccggctctttacgtgttttctcttttttctaagcgaaggacgaacagaattcctaatagacacgccagcagcgtacagcatacatcaatccagtccggctttccgccgtttagaaaagagttggttatcacggaaaccaggagaatggttacggtcaccgcggcaagctttttcttcatcggctccctccttcaccgactgtcttctgcttttacgggtcaaattcctctatctctatgttcggtcggcttttttcttgctatatagccttatcatgagggtcacaacgatatatacaatcataatcaatgccccgttactcacatcagggtatccaatcaacatattcattatgacaaaaacaatggttatacaaatgacggacaacaataagaagatactgaatgatttcaaatgaacaccttctttcccgcagtaacgtttcattataaaaagcttaccaaaagcggcaagctcttttcaaatctgcatatttcaaccaaagaattgttcacaaatttctttagcacctgcttcgccaactccattttcaattgctaaacataagggcgagcacactactgcgccgacagcacctccgacagccatacaagcacctgcgcaagcaatactagatccaagccccagcatttttgtgactaaatcgttacaggactccaattttgattttgccggagatgcttttttgacagagttcaataaagcattattccccttgccttttaatccatcttgattaaaatcttcattaataatttctttatctccaactcttaatttgaagtttccttcttttttttctttgtcccattttcctttaccctctactgataaaacgatttgctcagtgtttaaattaatatacctctgcgcaaatgaatgattttgctgatcttcataatgaaccaatgcaatcttatggtctttattatttaaaacagtcacaaagacttctgtttgatccatatccaaatcatctctgtctttgacgatatccaaagctttttgtctgtcttttttacttccttcagccttaatcgttttatcacagacagggcatgtgatttcatcttttattgtctttgtactaatagcttctgtcacacctgaaaaactgaacataaaaacaaaaataactactcccacaaaccatttgaaatgttttttcactatatatcctccttttattcagtctactactctatatccgcaaacggatacggtcaaaccaataaaagggttttttgtttatatcatccaaagtttgtattttcattatgatgactgcttttccttctcaaaacccatccatcacctgcacatcatacagcttgagatggcttttcggcgtgacgatgttttttaaatttgggatggtcaggtcgttcagtttttttcccgttttcaggtcgaaggattcgatttttgcgggctttttgtagctgtacgtaaacagatacagctttccgttttgatgggtcagctccttgaagtcggctttcattcgtgatgcggggagggtgaaggcctttttgctttttccggtctcagggttgatgcggtagacggttccgaagccgtcaacgaaatagaagctgcgatgctccatgaaaaagctttttttgaagctgaacggcatggagtcatagatcgtctgttcgtcatttttataagcggcgatgtcatacgttttgatggcgccgctgtttttcatgactttcaccatttgatagatgtaatcggctttttctcctctggtaacaaagcagacggcgctgtcgtccgcggcgagctgggattcgacagacgtgccttctttatacgtccacgtcgcgattgatgttgtatggagcttttctttatcggcctgaatgtcttggacgtgatagcctttttcgtcatctgtcggcgtgagcgcgaaaagatgatctttaaaaaagcctgaggcacggatatagtgcgggataacgtcttgcttccacctgccgtacatctggcggtacagctctgagcgatagctgccgccgctcttgtcgtagcccgaattatacagcgtgtaaaagcctttcgtccgttcgatatatcccgcgctgtctcccgtatgctgatacgctcttttatacgtgtgaaggccgtcctgaacggtgtagattccttttttgtcctccagcaggacgctttcgtcatgcactttggccgatccgagctcaagccccttcatttgataagaagagagccgtcctttttcatcggcgaagagggcgtagctttttccgccgccgaacgtgtcttggtcagccgcagtggagaaatacagcagcgcctctttatctttcagaaaatcagggtcatttaatgtgtctctcgcaacctccgcaggatcttccgtggggaaatagaagaagcataagaccgctgcggcggcgatgatcactaagggtatcgagatgatttttttcacgttgttctccttagtgaatggtcaggatcgtggttgtgtaggacgagcttgtgatgtcgcgcgggtatacgcctaagccgccgttagagtcgatatcaatccccgcttttaaaaggaatgccgaccacagcagttttgagcagtttttggcgccttcatggcccgtatttctgttattgacgaagttgaaggagtactcatcacccactcttgatacagcccagtcagcggcggcttgtttttgggcatcagtaactttcacggtctggacgattgaattgtcttcgacttctctgccgttatacgcaatctggcggacgccgtctcccggcacggattcgacaattttatcagcggatgaatacatgccgacatgcccgtgattgtaataagccgtgtatgagttcgtgtaataaatattgccttttgtgcttttcgggagttttttggttcctgacgatccgcccatcgcagagagtccgtctttggaagcgattacatttccttgcaccttgtctgccgtgatttcttgatgaaactgcttgagaattgcttctgttgaaacatgcttctgtttggcaagctctttggcggattggagaacgtcttcaggagtcgtgccctgctgaaggtctgcgatttcttttgcgtagcgtggtatttctgtttctttcgcttttacattcaaaccggagaacgacagaaccatggtgaatgacagggcaaacgggaggacggctttgaacagctttttacacattgacttcgcctcttttctcaaaggttaatttttccacgttttcattatatgacgaaattgtgataaaaaaatatacaatttacagatttttaaaaattttataacaatatgtaaatcatatacataaatcattttcaaatatcaggaaatctggttatcatacaagaaagggggaggacatatgaaggacagaacgatcggttcgatgcgggtttccgcaatggggttagggtgcatgggcatgtcggaatactatggcagccagcgtgaggaagagtcgatttccacactgcatcatgccgttcatctcggcgtgaatttgtttgatacggctgatcaatatggattgggtgcgaatgaagaacttgtcggcagagcgctcgccccattcagaaaggagctgtgcctcgcgacgaaattcggttatgtccgaagcgaaaagggtgagtttatcgaaatcaacggacggcccgattatgtgaaaaaagcgtgtgatgccagtctgaaacgccttgggacggattatatcgacctttattatctgcaccgggttgatccgcgggtgccgattgaagaaactgtcggcgccatgaaggagctgattgacgaaggaaaagtgaggtatatcggattgtcagaggcttccgcagaaacgatcaggcgcgccgtccgcattcacccgattgccgcgcttcaatcggaatattctttatggagcagggaagcagaggagcatgtgctgcccgcctgccgtgagctcggcatctcatttgtgccttacagtccgctcggcagaggttttctttccggaaagatgacgtcgacagatcagctggatgccgatgattacagaagaagaacgccgagattccaggaagacaatttggcggtgaatatagggctcgtccaaaaacttaccgccattgcccgggaaatgaatatcaccgcgcctcagcttgcactcgcatgggttctcgcaaacggcgatgacctcattccgattccgggtacaaaaaagaaacactacttggaagagaacctcgccgctctcgacattgtgcttccggaggatgtgaaggcgcggttggatgagatgtttccgatcggaacggcggccggcgagcgttatccggaacacatgatgacattgttagatgaataacaaaagaggcccagcgtgcgggcctcttttcatgacagctttttgctcatgatgacatccgtctccagaaatcctgtcttctcatacagcttccgcgccgtttcgttatgagcgaacacatggagagaaatcttgcggacacccaggtctttggctttgtcctccagccttgcgagcgcctcttttgcatagcctttgccgcggaaaggcggatgaaggccgaaatcataaataaatgcgtcctgctgcgggttgtccggatcggcgtgcagccacagccagccggcattttcctttccgtccaatgtcagcgtccataaatagtgatcggccgtctccaagccgtctggaagcaggtcttcaaatgccagttccgctaattccggcgcttcgtcaggcagccacgttcccgcttttaccttttcttcagcgtaatgcttggttgaatgagcgagataggactgaaattcttgtcctgtcatcggctgcagcgtgatagccattgaatcactccttacacgaaagcggtatcatgaagtattatccgaaggctccgttttccgccggttttatgatttggtcggcttgtgccgttgaaccagtttgtgcaaataatccaatcgaaatgagacttgccaaggctgctgagagtacaatgaatttacatgttttcattacgaatcccctccgttaatctcaaaatttggtcattggcatcaattgattcctgaaaatacttcgccgccggtttgtatttctcctgttttttaaaatgcgccgcggcctgatatgacaaatcggaaacgtcactccacagctctttccttcttaactcggcgaaagctgattcaagcgcttcttcattgcggtcaataaagacatgctgtaagatgcgcagcttttgggtgtatacgggttcgtttttttcttcagcggcattcagcgctttatgcagccaaaaccggccctcatccgtcttttcctgcttcaataacactctggccagcatgtacagactccggaccgaatacgctgatcgcaaatgctccttttgatcaagagccgtttcaaactcgacccgcgcctcctccagtttttcctgtctttcatagcaaatgcctgcgttaaagtgggcgagcgcctcaatatgcggatcgcccgctttggcggcttgatgaaccgccgtctgcaggagctcttcggctttctgatagtgaaacaagtccattctgttacagccgatcaccattaaacactgtgcttctctgaccgcgtacatttcattggctttgtagatctccaacgctttttccgcgtggttcatcgcaaagtagttttggcggatttcatagtaggcaatcgccacttgataattaaactcggctctttcaatctcattcggtatgtgccggagcctgctttcagcaatccggtaaaaattaatggcgttcataaaccgtttacggtaaaactcgtgcattccggaaaagaaataataatagtattgaatcatctggtctgttttttctttatcggcgttcagctggatcgtttttaaaatgccgtctgttttctcatactcttccattaaaagcttatagcgggaatcaattaaattaaaataaaggagcaccgtttgattttgtgtcatattttgcagatccgtaagcagttgttctcttaacgcctcagccgattcagtgttgtgctttttgatttcctcataccagtcactgatttttttcgcaactgtttcgtgggccatcacttcagccatctgtcaggacacctccctttcccattttgtgtaataaatatatcatatttacaggtccgaaaagagggtgaaagcccgctagtttcctcgtggcaacaaaaaaacccccgcaagtgcggaggcgcatattttataatagtttttttcctaacaaagattctaccagctcgaccgctgttttgccggttttgtttttgtgatcgaggatcgggttgacttcgacaaattcagctgaagtgatgatgtcggcatcatacagcatttccattgccaagtggctttcacggtagctgatgccgccgacgacaggcgtgcctacgccgggtgcgtcgctcggatcaaggccgtctagatcaagactgaggtgaacgccgtcacagtctgacaggtagtcaatggtttcttcaatgacctttgtcatgccgaggcggtcaatctcatgcatcgtatagactttcatgcctgtttccttaatgtattcacgctcgccttcatcaagcgatctcgcgccgatgatgacgacgttctccggcttgattttcggggcatacccgcccagattcaccagcgtgtcgtgcccgacgccgaggctgacggccagcggcattccgtgaatattgcctgacggcgatgtttccagggtgtttaagtcgccatgcgcgtcgtaccagatgacgccgagctgtttatagtgctttgccgttcctgtcagcgttccgatcgcgatgctgtgatcgccgcccaagacgagagggaaccgctcattctcaatgacgctgtccaccttttgggcgagctgctcgttccccgagagcacagagttcaaatttttcagatcttcatcatttttgagtttttcacgattgacggggatgtcgcctaagtcttccaccgcataccccatgtcagataaccgttcaatgagatgcgcgtagcggatggcgctcgggcccatgtccactccgcgtcgtgcttgtcctaaatccatcggcattccaataactgagatattcttgttcatccgtttttccacctcaacatgttgtatgttgtcctgtgcgggtttctcaaagatgacttggacacgaaaagatttaaagctctatctgtttttctgactgcttatgcttttttacatacagatgatagacgataacgcacaccgccatgaacgggatgccgcaataaagggcgagccgctgttctgaatcaaatgcgaggctgatcagaacaaccgtgtttaacgtcagcccgataataggcagcaccgggtacagcggtgttttaaacttcaggtcttccactttgccgccttcgtggatatatttccgtctgaacatcagctgcgacagggaaatcgtaatccagccgacctgcgcgcttagtccggctaatgataagagaaacatataaacggtttccggcgctgccactttagacagcagggacaggcaggcgacggccagcgtcacgatcaaagcgttcatcggcacgccgcgtttagttgttttgccgagcgatttaaaggcttgtccttcgttcgccatggcatataggatacgcgtcgatgcaaacaggcctgagttggccactgagagcagcgcaattaagataacaaagttcataatatcggccgcatatggaataccgatttgttcaaacaccacgacaaacgggctttcgaccactcccgcctgcttccacggaatcatcccggcaatgacgatgatggaaagaacgaaaaagacaagggttctccataccgtctgccggatagagcgcggaattgttttctcgggattttcactttctcccgcggcaaccccgatcagctccgttccctggaacgcgaagtttacggtaatcatcgtaataagcatagccttaatgccgttcggaaacaatccatcctcataaaaatgagagaagaaaggagcctgctcgccgtgtttcatgtcgatcaggccgaacatggccgcgccgcccaaaataataaacagcagaatgactaaaattttaatgccggaaaaccaaaattccgactcagcgaacgcttttgtggtaatcgcgttcaaaagaaacatcagtccgacaaacacgaggcaccacacccatacgggaacatgcggaaaccagcggagcatcaattgtcccgcagataaaaactcaatggcgcatgtcaccgcccagccgagccagtacagccagccgaatgcgaaaccgaaagcggggctgatgaatttggttgcgtacgtctgaaacgaccctgatacgggaagggcaaccgcaagctcgcctaagcagagcattgtcaaaaacataataaaaccgccgaccagataagacagaaccgcgcccagcggtcccgcctggttaattgtaaatccggtactcaggaaaaacccggtgccgatcactccgcctaatgaaatcataaacaaatggcgcgatttcattgtgcgctgaagctgattctctttttgatttgtattcactattctgcaccccttcagcaacttgtattggaaccaagccggtgctttgaaaccgatttgctgtccaaagagcctctatttgtatatgaatgttatatgaaattcattttcgtacataaagatacattatactaaaatactgtcgccgcgcaaatagagtgtgctgaattttttatttgtaaattccatacaagccgagggaaagcattgccgcatcaaggttttacgcgttttgaagcacgtttgtgatcttttggatcgcccagtccaagtcttccttggaaatcattaacggcggtgcaaaacggatcacggtatcatgtgtttctttgcataaaagcccttcgcctttcagcttttcacagtacggacgggccgcttctgtcagttcaacaccgataaacaggccgcgtccgcgcacgtcttttatgatcgggttatcaattttctctagctcttctttaaaataccggccaagctgaagggaacgctctgccagcccttcttcctcaaggacttcaagagatgcgagcgataccgcgcaagcgagcgggtttccgccgaatgtcgagccgtgggaacccgggttaaacacgccgagaatgtcacggttcgccgcgatgcacgaaatcgggaagacgcccccgccgagcgctttgcctaagatgaacatatccggtacgatattttcccagtcaaccgcgaatgttttccctgtgcggccgagtcccgtctgaatttcatcagcgatcagaagcacattttcttccttacaaatagcggccgcttcttgtaaaaatccttccggcggaatgacgatgcccgcttctccctgaatcggttcgaataagaaagcggctgtgttcggcgtgatcgcccggcgcagcgcttctgcgtctccgtatggaattaattttatacccggaagcataggtccgaaaccgcgtttatactcatcttctgaagaaagggataccgcgagcatcgttctgccgtggaagttgccgatacacgcaatgatttccgcctggttatcggctactcctttgacctcatatgcccagcgtctcgccgctttgacagcggattcaacggcttccgctcccgtattcatcggcagaatcatatcttttccggtcagcttggctgttttctcataaaacgggccgagctgatcgttatggaacgcgcgtgacgtcagagtgattttatccgcctgatccttcagcgcctgaatgatcttcggatgtctgtgcccctggttcaccgcagaataagcactcagcatatccatatattgattgccttcagggtcttttacccaaacaccctgcgcttcggaaataacaatcggcagaggatgataattgttcgcgccgtaatgtgaagtttggctgataatttcttgagattttgtgaaagctgacataatctgattcccccttgttttgtaatcattcaacattagatcttgctttccctttttataaagcaagttccgtgccaatccgaaaaaacgggatgtttcgccagcattctttcttttcccgcaaaatattccggcagtttgcgtgcaaacttcagccaagcgcaaaatttttttgcgtttcccgctgacaaaataggagcaatccgattagattgctcctgttcaacaattatttatttaattgtctctgatatacaatgtaagaatatagtaaagataatatgatacagccgattgccgcaatgaaaatgactgacactctatataccggcggcaaaaaggctgcaagcatcatgagtatgcccgctaagacaaaaattttcgaactaaccctgtgtgtatccttccaaactctttcactgctcagcgtccaaggtgttcttatccctaaaaagaaattaggcttcacgatctgaatgaagtttccaaataccatgaaaatgactcccactataaagtttcctaaataagatatagggagatcatatcccaggccggtcaagatggtcatcagattaatgacaaacagaaccgcaaacattgtattaaatatagccatatatggccggataaatgttttgtagttatttttaggatcaatcttagggatgataaccattaaaatatatacaataatcatgatgccaataagcatcatcatcgcattagctttcgtttggtaatcatttgcacttccgtttaatccccagtgtgtcgccaaattgtccggtaaagatgaataagtgcaaacccatgtgaaaacagttaaaacaatgattcctgccgaaaagagatattttttcatgattccccgcctttcttattatcatgttctgaatctgtcagagaaaagaaccagcctataagatcctgtaatacagtggtatttaatgaatacataataaattggcccttcctctcatcgtgaaccaaatcagtatttttcaatatggtaaggtgatgagaaatactgggttttgacatgtcgaagtgttccgcaatttcaccagctgtcatgtcttgtttctttaataaatccaaaattcttctccttgtaggatcggccagtgctttaaaagctttattcaaaaactttccccctctcatacgtacgatttagatatttaagtatatatctaaatatcaatcatttccctaaaaaagtcaatgattttattacctcaatttccatttatttttaaacatcgtccaagcgcaaaatttttttgcgtttcctgttcgatttattttaaaataatgaatgttaagacgattgagagggggaattgacctgcacacaaccagcgaattttacacactcgtgttacaaagcattctggaagagattgatgtcgggctgcatgtggtggacgagaagggcagcaccgtcatttacaataagaaaatgatgcagattgaagatatggatgaacgggacgtcctgcataaaaacctgactgatgtatttatgttttccaatcagcaggacagcacgctcgttcaggcccttcaagaaggcaaagcgattaaaaatgtaaagcagagctatttcaataacaaaggccaggaaatcacgacgatcaaccacaccttcccgattgtgcaaaacggcgagatcaagggcgccgtggaaatcgccaaggacgtcaccaagctcgaacggctgatcagggagaacatgcacaggaaagaacagaacagctacacgtttgacagcattctcggcaacagcccggtcattcgggaagtcatcgaaaacgcgaaacgtgcaacccgtacgtcatcgtccgtgcttttggccggcgagacgggaacaggcaaggagctgttcgcccaaagcattcacaacggcagccagcgctcaggcgccccgttcatctcacaaaactgcgccgccctgccggacagtctggtcgaaagtattttattcggcacgaaaaaaggcgcctttaccggagccatcgaccagcccggcttatttgagcaggcgcagggaggcaccctgctcctcgatgagatcaactctctcaatctcagcctgcaggcaaaactgctccgcgcccttcaggaaaagaaaatcaggcgcatcggatcagctcaggacaaaccgattgacgtccgcatcatcgccacgatgaatgaagacccgatcaccgccatttcagaagagcggctgcgcaaagatttatactaccgcttaagcgttgtcacgctgatcattcccccgctccgggagcgcaaggaagacattctgcctctggccgaagtgtttattcagaaaaacaaccacctgttccaaatgcatgtcgattcgatcagtgacgatgtgcagcaatttttcctggagtatgactggccgggcaacatccgcgagcttgaacatatgattgaaggcgccatgaactttatgacggatgaaacgacgattacggcggcccacctgccttaccaataccggatgaaaatcaaacccgctgacacggaaagcaaagcagccacaagcacccagcccggcacagatttaaaagacaaaatggaaaacttcgaaaaatacatgatcgaaaaaaccctgagaaaaaacggcaataacatatccaaaacggcaaacgagctcggaatcagcaggcagagcctgcaataccgcctgaaaaaattcggtctggaccggatgaaatgaatccatacaaaaaaaggctgaggtgctcctcagcctttcgtttatatctgattggcaagccgctctccggtaaaccaaaagttctcactcactgccaatgtatgttccgtattctcgacttgatgccaccaatggcgcggcgcgtaaatgatttctcccgccttttgtctgaagcggatcggagacgccttttgcgccagcggtttttgctctatgtctttttcatcaaagacattgatatttccttcgtacaaatacggagagtcgcccggatgatagaagatccattccttctctccgaaaatgacgccgttccacgcgtgcgtgctgttaaaatcctgatgcagcggcgtgcctgtctgcttagaaccgagaaagaaccatttccagtcccgtcccgtttcttcatccgctctcaatgtgtcttttgtaaaatactcgggtgcggaatagacaaggtctaagtcattttggttcagctgcgtaaaattccagtcacagtaccatttgtcatcattctgatcaatgtactcgatatagttggaaagctttacttgtttaaacgttttgaccccttcgatatctgatttccggatggtgaccattctgtctccatagtgttcgtcaatgtattcaagcgtccacggcctgcattcccagtgatccattgcccccgtcaaaataaaaggtttcttatcagcatactcgcttacaaaaagatcgtacgataactcattgattgtcagtctgtcaatggtcatatccattccccttttattcggcaatctgccgttttttttgtttggcgtaactgtatggacctgaaaagatggtgacgttttgattctcaagccagaaaatcttgttgaacttctccagcaggtttctgtcgtgagaaacgcagatgatggtgccttgaaactgcatcaggctgttttcgagaatttcctgagattcaatatccaagtggttggtcggctcatccaggatcaggacattcagctttttttccattaagatggacagcttcagcctgattctctcaccgcccgacaggacggaaagttttttaaagaccgacgacccgtaaaatccgtacttggccagcatattccgggccatgccctcttcagtcagcagattttctttaaagaattgcagaatcgtctgactcgaatctccgacttggctcttttgatcaatgtagcctatcttaagattttcccccactttaatggtgccgtccgacagttctctttccccgatgatacagcggatcagcgttgttttgccgacgccgtttctgccgacgacgccgattctgtctttatgctttattcgcagattcacattttgatataaaagggaagatccgttggccacctttccgttttcaatgaacacaatatcttttgaaccggcgcccgcttcctgaaatgcgttttttaatttttgctccgtccggaccggcttattgatcagctcgatccttttcagcgccttttccatattattcgcgcgtctgtgcaggctgacagacggcggattcgagcggttggcccaatctctcagctgggcgatggattccttcatcttctgtatttttctctgctgttcttcatatttctcaaactgggcgatgatgaattcttcccgctttttcaggtattcgctgaaaccgtaaggccaaatcttcacctcagtatcatcaatctcgagcaccttcatcgccgtctggtcggcaaacgttttatcgtgggtcgtaaacagaatggttttgttcgatttttttataaacccttcaagccactcaatcgcatggacatccaaatggttggtcggctcgtccagcagtataatgtcgtcgttgcggattaaaatttcggcaaggccggcttttgttttttcgccgccgctcagctttgaaaacggctgatcctttaattcactaaggctgagcccattgcatacctcgtcaatcatcgcgtgcatctggtagccgctgttccgctcaaatgtttccgtgtattgactgtacttttccaataaagcagtcagctcgtcatcactcatcggttccgaaagcttcagctcaatggccttcatttccttctggatcgccgcgagagcttcaaacgatttttccagatattgatacaacgtcagatcctcatggggatcagcgatctgcttcagcaaaccgaccttcgcccctttgttgatcgcaatcgttccttcatccgcctcaagctctcctgaaagcaccctgaacagcgtgcttttgccggacccgttcggcccggccacgagcactttttcgccttcattgatgaagaaagaaacttgtttgaaaatggtatctcccgctaaatttaccgtaagattatgaatattcagcaattcacatcatccctttgtcattctggttcaaagctcgactttattctggatggcgacgctcgctttcagtttgtaaaagctgagcatcataaacagcgacaataagatggataataccccgattgcggtcagcagcaaagctgaatcaaaatagtccgttaagaatccgataaacggaaaggcaatgaacatgaagagcgaggtcatcaaactgataatggacagcagcgtggctctcgttctggacggaatctcattattcaccacctgactggatacgggttctatcacatcatagagcgcgttgatgacgacaaaagctgcaatcgtcacgtacaggctgcccgaaggtataaacagataggccgccccgatgatgcagaatgtcagcagaagcacgcgcctcggcgtgaatttttccgccggctttgaagaaaagatggagcacagcgcctgcaagatggacagtcccgcaaaaataatggatatattgcgcacggacaacccttcctgacttaacaaatcttgtccgtacatataaaaaaccgatgtaatcgcaaagaaaacagacagtgacagcaccagatatttaaaggctttgttcagtctgaagaaatctttgacttcttttaagatgtccccgaccgtctgcgtttcgtgttcactgttttcaaatttgatttccgtcagctgtgtaatgaccgccatcgcaatcagctgagtcacaatcccggcgataaacacatacgaccatgatatttcctgcaagtagccgccgatgcccatggcgatcgcaagaccgagtatgacaagtccgttataatttccgatggatttgccgtaccacttttctttcccttgttctttcagtgaatcaaacaaaaaggcgtgatccgttcctgatataaacgtcagcccgataccgtatataatatgggcgatgaagagggcgatgaagttatggaagctcaggaacatcaccaaatagacaatgaccataaaatggccgagcaagagcgatttttttctcccgattctgtccgagatgacgccgctcggcacttccgccagaaacatcgccaaattcaggaccgattgcaggatgcccactagaaacaatgaataattcatgcttgttaaatataaaatccaaattccccgttcgaaaaagaagtttccgaaaaaaccggagaagtaaagcaaatttcgattccgcaaatgaatacccctttccagctatctgcatttaacatcatgaacagaaaggagcccgtcagtctttacactaaaaccctctatacatggatcttgcagatacagacttttcccaaaacaaattgggcaataatgagttgtattctcgaataacccaaaaagttccttctttttttcagatcctatggcatcaatgatcgtttttttcttccccggatcgctgatgtcgcggatgaaatatttgatatagctcagctcatgcatgtaagccggcaggaacaaatggagctcaatatcaaacccgcttttatccatatggtaataatcattgaaatgactgacgcgggagacggatacgtccgctccggcccgccgaaacaattcagccagcctttcaatgatctctccgttgggataataatcggcataaacaattcggatcggctctccttttgtcaaaaggggcggatctttctgcggtgtccgcccgctttcccatataccgatcagtgaatcagttggtgtgatgatatgccccaaatccccggccagcttttgtttatcaaaataatgctgaatgaaagatctcagcatgccgtcctttaccttgaaggtaaataacatcggcaaatgattttctttaaaatcagcatactgccgatacctcatgttggaatgatgaaactgggtgtggcaggtcacatcggtctgattcgcttcgtacagcccgatgcttttttccagatcatcattcaaaataaattggatggtctgaaccgtgcggtgatccgcgggcgtcattttatattgcggattccgctcaaattccagccctttctcaaacgtacgcttgaatcggtacgggccgttttccggcacatcgcccccggcggttcccggaatcagaaagctgctctgcaaaacggcttctatttcatcagacggctcgtccaaggtgacttcaaatcgtttttcacccgttacgttcaccccgagctgatcggaagagacgaggccttttacatacggaacggcctgttttatgttcaggaaactgccgagatggggactttggttttctttcgtcagatgatagatgatcgtttgaaccacaccctcggcgtcacctaaatagtctgggtgaatgtccacctgacaggtgcggcgatctttgcggatgattcggcagttatagccgtcctgcagactttcatacataatgctgcaaatcatcttgcttgtgtaatcctgcgtatctaatgggttcaagcgtatcgggcttgtgtcgatttctattttcagagggtcgcccggttttctcgccgtacgatgcatcgtcttcataaagcgctttccttttgagatagcttcgtttctgtaatatgaaggccgtcaaagtccaagccgatgcgggtattcagggatttcgggcttccgcctgcaaggtatgtgataatgtcatgagacataaacgaggatataataccgtttgtcgctcctaaagaacctttgatcggttcatcggggtaacagttcagaagtccggccggcatgcttttttcataggtgacgccggattgataggattcaggcgtgagcagaggcccccattggccgctgaagctgccgacacccccggtcataaacgcgatattccgctgcttacaatactgataaacccattcagaaatgttatggggtttgtcagcggcatttatgacgatatcaatttcgtacggatctaacacacgcaggtcctgcggctgtgttatttcctgatggtaaagtgctgcgtccgcatggggattgatacccgcaatataatctctgcattctgagacctttaatttgcctacagaagatttattatagacgaattgtctgttcaggttatgtactgatacggcatcgaaatcaatgagaataaaatgctgcatgcccgccgccaaaaggttttgaagaatgatcgttccgacgccccccagacccacgatcgctgccctgctgccgtctaatctgttttggatcagattggggttttggttgtatttctcaaaatggtacagctgcttttcagtgatgcagccttcacggccgttttgccatggctctattaaagcatccaatttcattaacgcatcgaaaaaccggtttcccgcttcctctcccagaagatcagaaagctcttgtttttcacagccggtgatcagccgttcaaccgcctcttttatctcactcgtatgcccaagcttaatcgcctttcgatattgaatgataatatgcgccgtgtaggtcagcacctgcacgctgtctttaaacttccagcgcttacagtccgttgacatcatgacataccccctgaaagataataactccccaatgaggggagtcacggctttactagcaacgctgcaccaagcttgctgtttctgtatcaagatcaagttcttcaatcttcatcagtacacaccccctttaccaataactagatattatcatcaatattggaaaaggacaagttattttttgaaaatttagaatttatatataaattgtgatatttcttccggcatcccggtttatcccggcagccggatgatgaacacggagccttttccctgctcacttttcacttcaattgttccgttatggctgtcgataatggtttttgtaatggcaagacccagccccgtgccgccggattgacgggatcgggaggtttccgccctgtaaaaccggtcaaacacatgaggcacatgctccggagcgattcccgttccgttatccgcaatcataagcatgattcccccgtctttctgcagggagacggtgatgacacccgtgtcttcatccgtatgctgcaccgcattgtaaaagagattgagaatggcctgcttcattttgtctttgtcaaaaacggcttctatcttttgatcgacaaagaactcgagtttccggtttctcgcgagcagcttcagctcagcctccatttccaaaatgacgtctcccaatgcgccttttttcatttcaaagctcggaacccggtcaatcttcgcgagaaacaaaagatcctctatcagcttattcgccctggcggattccgcgtacatgctttgaagcgctttttctttctgctccggcttttccgccgccccgcgcattaaaatttcgataaagccgtgaatggaggtaagcggtgttctcagctcatgtgatgcgtctgatacaaactgccggatacgctccttcgcttctttttccgcctgaaacgcggtttcaatccgttccagcatctgattgatggagatgcccaatgactcaatttcggcctgcttcctatcaatcggcagccgtttatcgagactgccggcatgaatgtcacccatcatatgcacaatgcgggacagcggcttgagtgtgagccggatcaccggcaaaaaaacaaacagtccgatgaccaaagccgcaaaggaaagcaccgcgaaaatgctgatctggcggaacagcgaatcattcagaggctgggtcagcgtgctcatctgcacaactcccgcctgccttccgtcaacggaaatcgccttaaacacgacgatgatttcctcacccgccttattgtgagccacctggtagtgaagcgccattgtatttgtcagcgcatcccgatacacgtttttcggaaaagaaggagcggcccccgcgtgcgggtcttctgataaaactgacatcttgtatgattgattgataaaagcaaccgtcaccccggggtaaatcaccttcggatgagccggtgtttcggaacgggcaagggttttgattgacctccatacgctttgatccattgaattgatatcactctgaatgctgatcgcctgattttcatacatcgtccgtttcatcaacatgtactgtgtgccgccgatgaaacataacagcaaggtcaacatcgccagtgacctgaacaggagctggaaccgcagggttctgtaaagccgtttcatgccagatccaccctgtacccggcgccccgaaccgtgcgaatcaccttgtgctctttgtccttcagcttttcgcgcaaagaacggatgtatgcctcgacgatattgttttccccgaggaccgttccgtgatgaagccccatcgttaaagaatcaatgagtgcagactcgccgtctgcactcagcagcttgatgcctttcaacttattcatgatgcagtctctccttagatgtatcagcctgtgtttatttttttcgcttccccttctattattcgcttttatcagaaacaaaacggaagctaagctgaattggtgaaagtaaacgctgaaaacggagccatctgcaaatcataatcaataagctgccgcttcaattcagcaccagtctgtttcaattgtctgcctttttctaaacttatccatttttaactgaacgtgttgagacccgcgttcagttcttttttatatcttctgaaaaaaggcataaaaaaagcgcccctgaaaaaggacgtttgatatgacgtgtttcattttcttaaattctgcattctaaaataattcttccttcacattcaccctcgatttcattcaatacgatgatcacatcagccgttttcatgtgtttcacctccccgcttcacaatagtataatattaacaaataaatcaataaaaagcagcccggacatccgggctgcttttttatttctgtaatcgatccgcttcggtcagtttgacttccgctgttcttttctttcccgaacggtagaacgtgatgttcacacggtcgccgatctttttgcgatacaggcgctcgcggagatccacaacgtcattgaccttatgtccgtcgaacccggtgatcacgtcgagctttttcaaacccgcttttccggccggtgaaaacgcgtcgacacccataatgaccgccccggttttaacgcctttcgggagtttcagcgtctggctccaatggtagctcgcaatatccgttaaggatttcatctcaataccgaggaaaggccgtcggacttctccgtatttttctaaatcctgaataacgggaatgacaagctttgacggaatggacaggccgattccttcaacggcggattcagcgatcttcattgagttgatgccgaccaccttgcccgatatattcatcaaagcgccgccgctgttgccgggattaatcgcggcgtcggtctgcagcacttccgcattccaatccggatgtccgtcgccgtttgagtcaacaggcaccgccctttccgtgcctgaaatgatcccctgtgtcactgaacccgcaaattcaagtccgagcggatttccgatcgcaatgaccggttctccgactttgacttgatcagaattgccgaactgggcggccgatttgattttatcagacttcaccttcagtaccgcgagatccatcagacggtcgctcccgatcagctcagcaggcacgcgcgagccatccttcaggctgatctcaatctcagtcgcaccttcaatgacatggtgattggttacgatataagaagtgtttccgttctttttataaatgacgcccgacccgcttcccgcttcgccgccctctccccaaatatcggtcttttggatattgagaacgccgactaccgaatctgatacacggctgaccatattcgtgacagcgtcattgacatttacgttgactgttttcacctgttcgctgccgagacgccggctggtgcttttgctgctgtctccatggtctccgcctgtccagtacggcagcaggaaagccatgagcgcggccccgacgatgacgccgatcagacttgatagaaagtatcctctcttgctgcggcggggctgttcggaggcgtactgttcatcatcgcgattataatccaccctatctcaaatcctttcaagagtactcgatttgcttatagtgtgggtcagatcgcggattaataatcatgattcatttggaaaaattacacggcgcacagcggcgtcggaattttcggatcggtatcaaataactgaaacgtttccccggcgacaaatcctttcgcagccaatgtctgctgcacggacattctcgccagttccttcatattgttgtcttggctcagatgcgccaaatagatgcgcgatgtgccgtcgccgatgacatcagtcatggcgagcgccgcatcttcattcgagacgtggccgacatcgcttaaaatccgccgcttaatgctccaagggtatctgcccatttgcagcatgccgacgtcatggttgctttcaaacacaaacacattggccgaacggatgatgcctttcattctgtcgctcacatatccggtgtccgtcatcagcgcgagctttctgccttggtagtggaaaacgtaaaacatcggctcggccgcgtcatgagagacgccgaatgactcaacatcaagcccgccgaaagatttcacgctttccatcgggaacaaaaacttttgtccggtatccagcttgccgatctgattctccatcgctttccacgtcttttcattggcgtagacgggtagaccgtactttctcgcaatgacgccgagccctttaatatggtcgctgtgctcgtgagtgacaaagatgccgtcgacgtcgtctatcttacggccgattctctccatcagcccgtccatcgctttaccgctcaggccggcatccaccagaaaagagtgctcctctgtctccagataaaacgcgtttccggtactcccgctcgcaagcacgctaaattgcaagcccattgtgtctcactccattatttattttgattgttatcaatgactgtgctttccaatgcattcacagtgtacgtttgctgtgtctttttcttcgtcccttttgacttatcttcaattgtaattctccataccggcgccagcacctgcgtacttgtcagcgggtattgggcaatatagccgaacttgacgcttttaacggcgcaattcgcttttaagtaattttgagaatacaataattcgaccgcatcaagctcaggaatcaggctctccgtctggattcgcttgaatgactccagcatggtctgctcgtaagatacgacctggtttttatcgttcagatgcagaatcacctgtccgatcgcatccgtggacgagtcaaaatcctgataaataaactgtccgtcatacgtctggtaaaaaatgatctgtttttgatccttgtcgactttccacagtttatatttttcaccgccggttactttagagctgacgagcgattccgcatcctcctgcggtttttgcttcgataaaccgaccggatcggtaaatttcattttcagcgttgtgaccttatgatcatccgccggcatctccattaacggcttttgatccttcaaagcatcaatatcttcagcggtaaataccttttggcccgccgtcagccggtagcccgtcgcggaatcagaagacaggttgccgaatgtgatatggtccatctccatgtctttttccacgtttgaatttttaatcacttcgtattcactgctcgagcgtttttcaaaaaactgatagccgagaaaaatatcgaggatgaggaaggcaatgatgaagatcgtttttgtcttattccactccattatcgtcctcctccttccccagcagatctttcgtaatcgggacgatcttcccgttgattttcatactccagacgggttccagctcaacaagatcattcgttgacgaagagaccatttgataggacaggaagatctggtcgattttgttcacgtcgtatttatcctgctgctccagcagagacacaacctcattgccgttcatcatttttacgtcttttgttttaatcggattcggcccgagaacatagttcggccgcttgtagctgagaacctcgtcattggcccattgcagggtcaaaacagggccggatccgaaaggcttagacgtgctgttgatcacaggcatttggtctttaaacatgtagaaactcagctgctggttatcactcacattaaaaaattgataatgatccgtccagcttcccgtatcctctaaatatttatagcttttcttaatcagctcacccgtttggtaagaagcgctttgtgccaggttccgatgctggaattgaatctgccgctgtgtcgaattgatttccagacggctgattccgtcagtcagcacattccgattgtaattcgggtcctctctgaccgtgctcggatcattaaaaagcgtctgcttaaacaggttcgtcttaatggtttcagtgataaattctttttccttcatattaaaccgcgcattcggcatgagaaattctttgctttttccgaccgaatagaggtggtataacggcatactcgactttttgctgtacagctcattcatcagattgcggtaattcgccgattccacagtcacttccaaaatcagctgcttgctgtatgagaccatgtaaatcttcttattcgtcttattctcattaaacggaataacaatatggtcaaatgagctgtattccattgacggatttgaccatttaaacatcgattggaagaaatcaatcggaatggtgtcattgaattgcagatcgagctttgccgaattgccgtttctgccgtaaagccaatttttaaaaccgagcttgtcgtattgatcggaaatatccttcatcccttttacttcccattgcggcaaatccgcccacaggtcattaaagagcgtctcatcatccactttataatgagagccgtttgtatgaataaacatatcccggggttttaccgtttgcgacactttttggctcgttttatcaattttatgcttttcccggacagtcgatttggttgaggccgtgccttctgaaaaattgggctggaatgtccaaattccccatgttaaaacaagactaatgacgaccagcactgacagtatgactgtttttatattttcacgcctcatcccaatcatcctcttgctcttctttatatggaagagtaaatgtaatcttcgttcctttgccttctacactgtcggcccaaatgtctccgccgtgcgcctgaaccatctcttttgcaatcgcaaggccgagcccggtgccgccgagttttctcgtgcgcgctttatccactctgtagaaacggtcaaagactttttccacatcttttttcggaatgccgataccttcatcttttacgctgatataaagcagctcttctttctcgttcacatcgactgagaaagtgacatgcccgccttccggtgagtatttcagtgcgttagaaatgatattatcgagaacctgcgtcactttatcctgatcaatctccacgtacagatttctgtccggaagctcgcggataaattcgacatgctgttctttcgtcatttcaaaacgatcgataatcagtgacataaagcggatcatatgaatccactcccgattaaactgataatctttgctgtcgaatttagaaagctgaagcaggtcgttcaccaatctgatcatgcgctcagtctcattttgggtcaccattaagaaacgcggagcgatatctttgttttcccacgcgccttccgcaagcgcctctaaatagcttcgcatggtcgtcagcggtgtccgcagctcatgagacacgttggcaacgaactctctgcgttcccgatcgagtttttcctgttcggtgacatcataaagaaccgcgattaaaccgtcgatttttccgtgctctctctgaataacggaaaaattcacccgcagtacagtcgtttcatcgtcacgttcgatctccagcagcattgaatcctgctgttctactaaatcctcaaatgtaaagttctcttttatgcccaataaagacgtaatcggcatctctaaagccgtttcacgtgaaacattcagcagctcaagcgcagggctgtttaaaagaataatagccccgttgcgattcgtagcgatgacaccgtccgtcatatacgcgataacggaagaaagctttcttctctccccttctgtcatggcttgggcatcttcaagctctctcgtcagatggttgaacgtcgttgcgagctgaccgatttcatcatgcccgtatttccgcacctttcttgagaaattcccttttgccagttccatcgcctgcttacgcatatccgacagcggatgggtgatggtgcgggcgagaaaaataccgagaagggccgtcagaacaagggctaagcctgttcctgaagcaagaatcgagttgacggttttcatctggttaaaggtatcttccatactggccacgacataaatcgcgccgacaacttcttgattctctgtgacgacaggttttgctgaaatcagcactctgtttttgcttttaggatcataatatttttttgaataggcctgttttgttgagaaaatccgtttaaaaatcgggtcagtcgtctgtttccccgctatttcctcgccataaggcctcgaagaaccgacgacctcatagcttttatcaacaaatgtaatctcccgtatttcattgtttttcgtaaaatcattcaaaatccgtttgacgtcatctttaatgacggtgctgtcattatctcctttatattcctgctcaatataataggatagattgtcaatccgctgatttaacgataattcataggacttgagaagagaattctccacctgtttcacaaagtacacgccgataatctgcatggcgatgataatgagaagcacatagatcagcgtgatcttaaactgaatcgaccgaaaaaaaccaaccttattcatcgccggttagtcctgttcaggatttctcaagtaataaccgacaccccgtcttgtgacgatccagttcggatggctcggattatcctcgattttctcacggagacggcgcactgttacatccaccgttctcacgtcaccgaaatagtcatagccccacacagtctgcagcagatgctcacgcgtcataacctgtccgatatgtttggctaagtaatgaagcaattcaaactcacgatgagtcagctcgatcgtttcttctctttttgatacgacataagcgtcagggaagatgacgagagaaccgatatgaatgtcattagaagctgattcttcctcagccggcgcaactgtaagctggcggcgcaggttcgctttgacgcgggccagaagctcacgcgtgctgaaaggcttcgtgacatagtcatccgctccgatttcaagcccgatgaccttgtcaatctccgagtcttttgccgtcagcataataatcggcatatcatattttttccggacttcccggcacacttcaactccgtctttattcggaagcataatatctaaaagaattaaatcaggctgaagctcctccaccatttccacggcttcgtttccgtcgtacgcacaatgcacgtcatagccttcttttcttaaattaaactctaatatatctgcaatcggtttttcatcatcgactacaaggattttcttatccatcatcttgattttcctcctgccagaatgacttcatttcatctattgatgtttcatgatgatcacaattcgcatcgtgaaaaacgttccccgtctattataacggtttcaggtcaaaagataaaaaaattaaagagaacagcgcaaaaacgtattgaactgccatccttttgtcatgttttttattttcttttaaaaaataatatttttttgaaacctcacgaaaataaacgccgtctattgtttgacgtcttcttctgggccggctgaaaagccggctctcccttttttataacaaagaaaaaacgcacctactattgcagatgcgtttgggtaagtggctcgggacggaatcgaaccgccgacacacggattttcagtccgttgctctaccaactgagctaccgagccagatgtttcttttctatactataaagtaaagtaaaatggcggtccggacgggactcgaacccgcgacctcctgcgtgacaggcaggcattctaaccaactgaactaccggaccttacagtaatttgtccggagaaccgtatcgtggcggccctccgaggacaaataaggagttagcaataacgctaaagtaaatcaatgacccgtacgggattcgaacccgtgttaccgccgtgaaagggcggtgtcttaaccgcttgaccaacgggccataaaaagtggtgagccatgaaggactcgaaccttcgaccctctgattaaaagtcagatgctctaccaactgagctaatggctcttgatgtgtcggattatgtatcatagagcattgagacaaaagctttcttgcagtactctattgaagctgttccgtaacaacgagatttataatatcatagaacattcgaaagtggcaactacttttttgaaaaaaatctattatttttttcctacataaaaaacaagcctccatgaccggaggcttgtttgctgcaaattcttagttagcgcggtatacgctgcggatgacgttcgtttgtgaacggtcgggaccgacagagaaaatagaaagcggaatacctgtcagctgagatacgcgttccaaataatggcgcgcattttcaggaagatcgctcaatgtttttgcgcctgtgatatcttccgtccagccaggcatttcttcatataccggttcacactcagcgagggctttcaggcttgccgggaattcttcaatcacttcacctttgtagcggtaagcgacacagatcttcagcgtttcaatgccagtcagcacatcaattgagttcaaagaaagatctgtgattccgctgacgcggcgggcgtggcggacaacaacgctgtcaaaccagccgacacggcgagggcgtcctgtcgttgtgccgtattcgcgtccgacttcacggatttgatctccgatttcatctttcagctcagtcgggaaaggaccgtcaccgacacgggttgtgtacgctttagatacgccgacgacgtgctggatttttgtcgggcctacgcctgaaccgatcgtcacccctccggcgaccggattggatgaagtgacaaacgggtatgtcccttggtcgatatcaagcataaccccttgagcgccttcaaataaaacgcggcggccttcatccagcgcgtcattcagaacgacggatgtatcgcatacatactttttaatctgctggccgtattcataatactcatccagaatatcttcaattttgaagccttccgtttcatacattttttccagcagacggtttttctcttcaaggttccgttcaagcttttctgcaaacacgtcacgatctagcaggtctgcgatccggatgccgatccgcgccgctttgtccatataagcaggtccgatgccttttttcgttgtgccgatcttgttggcccctttgcgttcttcctctacttcatccagtttcagatggtatggaagaatgacgtgggctctgttgctgattctcaagttatccgtgctcacattgcgctcatgaagatacgcaagctccgttacgagcgctttcggatcaacaaccattccgttcccgatgacacacgctttttctttataaaaaattcctgatgggattaaatgaagcttgtacgtgacgccatcaaacttgatggtatgtcctgcattgtttccgccttgataacgtgcgatcacttctgcattttctgataggaaatctgtaattttaccttttccttcatcgccccactgcgtacctactacgactactgaagacatatatccgtgcacctccgttaacctttcaaaacgatatctcattcaaacaaattaagtgtatcagtgcagaaacagaaagtcaatcgtaaatccgaacgtttaaatcttattattctatatttgttcgccttaaacctgattaaaagcgttttctctttcatttgctatctattactcccgaaactttcatactttaacatgaaaaagaacccgtatcccaggttcttcagacagtcatttatattccgcttgtattcatcaggacgatccgccagccgtcaggatcttcgatggtcacgcctttttcttcccagtacggattttcggattctttctcctcatatcccatctgctttaatttcgtgctgatgcgaatgacctcctgctgatcagggatgtaaaagacaagcaggctgtcgccgtgcggaacgggcgccggctgagacgagccggtttcttcggtgaattctaagtgatattgcgtatgcggcaggccgaacatgacgccgctgtagccctcatgtccggaaaaactgccgattctcttcaatccgaggccttcttcataaaacctgatgatttctttgagctgtccggtcggccgggcaatccggatttgcgccgcttggaattgcggaaattcaattgtcatcatcatccctcccttaatgccattatataaaagcgctttctttttttcgtctgccgaacggacggcattctctcattctttcggatgaaaaaaagcctcaagacattgcttgaggctttacgcacctgccggaacaccgccgtcatcaaagcgcctttccaggtttacgaacttattgtattctttcacaaaagccagtgagacggtgcccaccgggccgttacgctgtttggcaataatgatttcgatgatgtttttgttttcggattctttatcatagtaatcatcacgatacaggaaggcgacgatgtcggcatcctgctcaatacttcccgactcacggatatctgacatcatcggacgtttatcctgccgttgctcaacaccccgggagagctgagacagggcgatgaccgggacttcgagctcccgcgccagcgcttttagcgcccgtgaaatttccgatacctcttgctgacggttgtcgctcgaacggccgcttccctgaatgagctgcaggtagtcaattaaaatcatgcccaatccgttctcctgcttcagcctgcggcattttgaacggatttcgctgacgcggatgccgggggtgtcatctataaagataccgctgtttgacaggcttcccatcgccatcgtcagcttgccccaatcttcttccgtcagattacccgttctgagattttgggcgttaatattcccttcagcgcagagcatacgcatgacaagctgctcggcacccatctcaagactgaatatcgcgacgctctcatccgttttggtggccacgttttgcgcaatatttaaggcaaacgccgttttccccacggacggacgggctgcgacaatgatcaaatcattccgctgaaaacccgccgtcatccggtcaagctcgataaagccggtcggaatcccggttatatcgcctttccggttgtgaagctgctcaatgttgtcgtatgtttgcacaagcacgtctttaatattttggaaggcgcccgaattttttcgctgcgcgacctccataatcgttttttccgcatcgcttaataaatcttcaacttcatcctcgcgcgtatacccgtcttgagcgatcgaggtcgccgttctgattaaacggcggagaatggatttttcctcaacgattttcgcgtaatattctatattagccgctgtcggaacggaattcgcgatatccgtcaggtaagaaacgccgcccacctcttctaacaaatcggtattcgcaagctctgacgttaccgtgaccaaatcaaccggttcaccgcggtctccgagcacgagcatggcattgtaaattttttgatgtgacattctgtagaaatcatccggaatcaacacttcagaagccagtgtcaacgcagacggctgtaaaaaaacagcacctaacacggcctgctcagcttctatgttttgcggcggcagccgatcattcagaaggtctgtcatgctaagcaccgtcctctccttaaaaaatatccaaactccattttaccatttctcatgaaaaagaatagaaaaatatcactttccctgtatttggaggagagggttatgtgttttgccgttccgaatgccgggaaacaaataaataaatcgaaaccgggaggtaagaaggatgaaaacatatgctgtaacacccagtgttgatgcggacggatggtttgtgaaggtggaaaatgtggcgccgacggctctttatacatcaaaggacgcggcgatcgagaaagcggagcagacggcgaaagagaacagcccgtctaagcttgtcatttatgatcagcataaaaacattgaagaagaacggtccttttaagaaaagccttcgcccgagcgagggcttttccttattcgatgaaacggatgtgcagcaccgtctgcgccatgagatcggccgttttttgatacagctcccattcttcaaaggcggcgaatactttcatcatgtcctgcaatgtctgtttcagtatgataaattcgtcaattgtccgcagttctgcggcttttttctgataatcagccagcttcagctgtaataacatcaatggcgattgcataaaaaacctcccccattctgttataaagccccgcttttcaaacctccattcctttgtcatatccccttacgatagatttctgattttagtacaataaagaaacggaaggagtgatcacatgaaaccgctgcaaatttccgccgaaacggcgcaaaagctcgcagaatcactgaatatgccgcttgagagaatcatgcacatgcctcagcacattctgcttgccaaattagctgaaatccaaaaagagaacgatcacaaataaaggccgctctctcatatatatgtgcgggaggcggaagcgatggctttccgcctcttttttccgtgaagaaaatttcggtaaaaccgtctcacagctgaaaaaacttgttgacgaaggaaaagtgaactatttcttataatccggaaacaattcaggcaacacaaagcttgtctcatggattaaaaagaacggcacaaaaatctcagctgaccgatacagcaccggaaaaacaagctcagcccggcaaggaatgacaggcggcccgggcggacaaagccagcggactctgtatgagatgaaaaaacagctcggaaagaggctggatagttaaacgccggcctctttattctgctcttgaagcacctgccatgcggcgccggtatcattcagaaaaatgattgataaatcctttctatttttgaaaccatcagttcctgacgcagatgccggacggcataggagcgcgcttcttttccaagccgttccctgagagactgatccgtaatcagcattacgagggcatcagcaagttcgcggctgttgccgggctgacagataagccctgtgtcctcatgccagatcatctcagggattcctccgcagtcagttgcgacaatggcttgacctgagaacatcgcttcgatgatcgctatggggaaattatcattcaatgtcggcaggacaaatatagatgattcagccaaaagcgccggcacatcatgtcgttttccgaggaaaaacacatttgagaggcccagtttccgtctcttctcttccagaaaccctttcatgtttccgtctccgatgatccatatatccactccggataaatggtgccggatgcgggcgagggcgtccagcagcacatcatgtccttttcgctcggtcagacgggaaacgcacgcaatcacgagcttttcagcacgttttggctcgggtgcatcccggatgtcaatgccggtatgaacagtcgtcagctgagcctccttcgctccgtactccagcaagggctcgtgaaaggagtcgctgattgtaatgattttatccgaagcccgaataccctgcctttctatttcactgaaatatgcctcttctattgaacccttttggattttatgaaacttcatccggcttttcgtaaaatgtccgtgcggcgtaaaaaaaagcggacgccgatacgtttgattaaggtatcccagcaaaaataccgcaaataaatcctgcgcgtgaaacaggtcatattgttctaagtctttctccttcaaaaatctttgaaagacatgtaaatagctgagattcttcacaaacttttcgtttgcggcgccgtatctgccaacaagaaacgctctgatctcgtcagcggcccgcgggatatcttcctgaaaaaaagctggcggcatttggagcggcgagatgacatccgcctgatgaccgatgcgctcaaaacccgtcttaattgacgtgatataactcgccagtcctccgacattcgggtaacggagaaaggttgcgtacagaatacgcaatggcttttttcgtttgggggagctttttccttccgcacagaacgaatacagcatctccggctcactttgatgttcgatcccgtaaaattgatccatgacgcgcaataaggcaagaggcaccagaccgttcggcttgccgatctcttctttcaaatccgctccccctctcttaaacttataatcctaattcccgtccccattttgacactttgtcaacatgatacggcaacagttctcctccccgattgtcgaagattctccgcaattgggtatgaagccctttctcaagtgttctctgcaaataagccattttataaagcgtcataggaggggtctgaaaatgaatgccccgctttttcatttctttcgtatacacttttacgcaatacgtccgaatatcttctgcgtgccggctccaatcttttctgaagccgagcagaatttcaaccagcaccgtcatatcaaaccaaaccggcgcgtactttgcggattcccaatcgatgaattgaatatcccacggttcatgtccggacgcatcgtgggtgcagatattctgcatatgaagatcaccgtgtgtgatggctgagccgttttggatcaattctgggaaaaaatccggctcctcctgctccagcaagtttgtgatttgccgataatgaggcttcacgatatcctttgtgcgctcatctttaagagctctatccaataattccgctgtctttttgatctgctttttacgcccttttctcatggtttccgattcgtataccggcagccacgaccgccatttaccgtcagaaatagtcttgttttcaaaggtgcggctgtgcagttctgcgacagacggaataatatacttgaaatgcttcggatgaaatgtaagctgtcctctgatctggctgacaaactccataaatatccacgtttcatggtcactttcttctataagatagatgtccggcagcaaatcccctaaaacagaacgggctttcccgtatatattaatctcgaccttgtttttttcacgggaagatttatacaccttcaatatcagcggaacaatgccggattttttctttacaaacagtttataaatggcgcttctgtctgttgatttcaggcatgtgatgtcaaccggattcaccgcggccctttcaccgaacgaatacgacagtttttcgtcaattctcagtttttgaaatgcgtcatacaaaagatccttttcatacatgccgatcttccttccgcttccgtttccagctgtttttgagatgagaccaagtgtttctgataaatggcatcgggtcattccaagcaaaaagagcgtactctttttttcctttaaatcctttccaaaaatcccggaacgtcatttctcctctttttcgtttcttcaaaaacgttaagaagtaacgcacctcataaatccaattgattccgtctttttgttcgagctggggcttcacctgttgtccggtcaaatacagatagtacatgtaaacgaaatgaatgcctgccggttctgtcaggctatggctgagccaaaagcgcggattaatttcgataaacttgtaaacattgtctcggggatcctttttaaattccgccatgcctactcccttcagctgaatcgcttcaaaaaacggcagggtcttctcgattaaatcaggaagccgtttgctgacgacgtgggcccccgcgccaaaatcagcagggaattgatggttcttttgcagagagaataagcccattaatttcatttggtcatcataaaaagtggcgactttataaaaacactggttgtctccggggatgatctcctgcacaagcagttctccattttctctgtaggagctgaactccttgcgcaattgtgcggcatccttcattacaattgcttttttgtttactttttttctgtattcatggccggccaccggttttaaaatacacgggaagtcaatattggcgatggcctcttccagctcatcccggttgttcggaaaaaaggttttcgggcaggggatgttatgcttgaccgctaattcatatgctttgcttttatctaagaccgtttctaacagagagcggctcgggagcaaaaataaaaaaaaacggctaatgtctcgcggaatttagatataaatcccgcataatcatcagatcctgcgtacagaaccggctttgcttggaatcgcttcccgaaatcagtcagaaatgtcagcagttcttcctcttgtgttaaagggctgggacatatcccgcaatctgccaatcttgattttccgatacgataaggtccctccgtgtcaaacgcgtaaacatcgattcctcttcgggccaggctgcgaatgatcccaatcccgtttgcactgaaatcaagtacaacggctgcatgttcatgtttcatgatctccctccgagctgttggtattttgataaatcgattcgatattttttatcatcgtctcactgcttaaatatttctccgcgtaggcctttgcgtttgaagcagccttctcccgcgcagatttgttagagataaaaaacgctaaagcccgggcaagaacctttgcatttcccggctcgacaataagtcccgttttgttatggcggatcagatccggaatacccccgcaatcggtcgcgatgatagccgagccgctgaacatcgcttcaataatcgagatgggcagactatcattaatggtcggcagtacaaatatgtccgtcatattcaaaatagcgggaacatcatctctttttcctaaaaaggagaccatagatagattcagttttcgagcctgttcctctaaggcgctcctcatctctccgtcgcccgcgatcagcacttgaacatgttcaagcacatcagacggaattcgtgaaagtgcgtcaagcaaatgattatgtccttttctcgggcctaatcttgcaatacacgagatgatgatcttatttttcggcagcgggatttttcttttcccgcctgtttttgcatcgtaatcgattcctgtgatcaccgttgtcatgtcttcctgttcggctccgagcttcatgagcgggctgcggaacgtatcgctgataataatcaggcgatctgcgtattcaatggctttcatctctagttttttataataaaactcttctatcgatccttttttaaagatgtgaaatttaagtctgttgaaagtaaacatgccatgcggtgtgaaaaataaaggtttcttatagatttgattgaatctgcctaatatattggctgtaaataaatcttgagcatgaaacacatcatatctttccaaatgaatcttttgaagcatttgctcgtatataaacatcagcctattatttttcaaaatatgattgttataatccccatatctgtccttaaagaaatcttttaacttcggaacaacagccgcccgcagttcttttacctgtgcggacggaaacagattaggggagatgacatcgaccttatgacccctctttttcaggccttcactaagcgttttaatatagtttgataaaccgcccgtgtgcgggtagtcccaaaacgtggcaatcaaaatggataacttcttttttttcctgtataaccgcggaatatgatgttcatgtttcaactgtgtctttactgccgcctttttttgagggcgcgttttgaccccgtagtagcggtcaagcgtctgaaccatatacggatacgggacggaaaatgtcttgatcatttccagatcctccgcacgacttcaaaagcttcggcgtattccacacccgccgtcatccctctgactcttcctaaatgtttaacgccttcatatgaacggggatgagggtaatccctcatttctacgtcatagtggtgaagcgccgcgagtttggcatccattgtgtctgtgatgttaacgaagtaattaggtttgaagagtttatcagccgtattcctctcccactcgcttgaagatagcgtttcgaacgtaagcagttcgataggcttttgattcggaagcggtctggcggctgttaaaactgcttggaatgttctctggtggtccatattgatatcgccgtaatgatgtgtaaagattttatcaggctgatagacgcgaatgagctgctctaattctttgacaagcttatgaagcgggatacattccagctctaaattcgtatgctccaaaaagatgactttctcaattccaagctcttgattcgcgcgttcgcctaattgtttaatatgatgagcttcttcttttcttcctaatgccgtaataatggaaatcactttatatccttcattgatcagccgttttatggtgcccgctgctcccaatagttcatcatcgggatgagcgccgataaccataatgtattctgccattttttccacactccaccaaacaaatgttacaaatatcatatgacgaccctaaaaaaaggaaacttacatatgcggattttcagaaacttacatgtgcggctgccattccaggtaacgtgacggatttgttttttttatagtgttcaaaaactcatctgccaagccgtatttgtccagtccttttaatagttttacgggaaaccgggtaatggcggaaaaagctcttttatggtcgatgaccttaagatttccgtgttcgttaatcagaatgtgcctgatttcggcatcccatctggtaaaaccgattctttttaattcatccagcatatttaaaatatcagcagtcagtttgacggacagagatttttcttttctgatatggcgggcaagagaggtgccttggacatattccatcacaatataacgatctccgtattcatacagtcttggaatcaccggggaaccttgtccggtctttaaagccgccaattccttcttgcatgtccctttttcaaagaagtattttatgcatttgttgtgtgttaagcggtagacttccccgtcttttccgtctccgatcagcggataatgctccagcgcctttttattctccggattattaaaatatgtttcagaaaaaaatcgtttcataccgacacatccttcgttatgatgtaatataatatgcaatctggtagcgatcggaaatgaaacaatctcatcattttcttgcgctgcgccgtctgctgacataaaaaaacccgccggatcggcgggtttttcattgtgtattacgcttcttcttttacgtgaaccttcagcacagcctgaacttcagggtgcagctttacaggaacgtttgtatatcccagtgtgcggataccgtcttggagctccagtttccgtttatccactttaatcttatgcgttttttgcagcgcttctgcaatctgcttgcttgtgacagatccgaacagacggccgccttcaccggatttggcactcagctcaacagtcagctgttcaagcgttcctttcaaatctttcgctctttcaagctcggcaatcgcttcttttttctctttttctttctgtcctttcaatgcgctgatgtttgtcgcatttgcttcgacagcgaggccttttttaatgagaaagttatgtgcataaccgtctgctacgtttttcatttcgcctttttttcctttaccttttacatcttgtaagaaaataaccttcatctctgaacgcctccctcaaaatattcatcaatggcttccttcagccggacgagcgcttctgagacagaaatgcccgataactgggttgccgcattggttaaatgccctccgccatccagcgcctccataataatctgcacattgacctcgcccagcgatctcgcactgatgcacaccgtatgctcatcccgtctggctaccgcaaatgaagcttccacttcactcatcgataagagggaatcagccgcctgcgcaatcagcacctggtcaaagtactcctcttcattctcaggaagagaagcaatcgcgatatgttctttataaagagccgtatgctggatcagtttcgcccgcttgatgtaagaaccgacggattctttgagaactttctgcaccagaaccgtatctgcgcctttcgctctcaaataagaagcggcgtcgaacgtccgcgagcccgtgcgaagggaaaaactcttcgtatccactattataccagctaacagggccgtcgcttcaatcatattgattttgagccgcttcggctggtattcaagcagctccgtcacgagttctgcggtggatgaagcgtatggctccatataaacgagcagcgggtctttaataaattcctcgcctctgcggtggtggtcaatcacaacgatgtgctcgattttgttcatgagacgctcttccatcacaagggacggtttatgtgtatcaacgacgacaagcagcgtgtcgtcatttgaaatttccatcgcctcttccggcgtgatgaaccgcgaccacagctcttcatattttttaatttcttcaatcaggcgctgaacgcttgatccgatctggttcggatcaatgacgatgtagccttctttgccgttggcctgcgccaccttcaatattccgattgcggctccgactgcgtccatatcaggaaacttgtgccccatgataatgacattgctgctttctgagacaatctccttgagcgcgtgagaaatcacccgggcgcgcacccttgtgcgtttctccatcggatttgttttgccgccgtaaaatttcaccttgccgttcggcattttgatcgccacttggtcgcctccgcggccgagagccaaatcgaggctggactgcgccagatctcctagctccttcaaggaagaaaccgatgcgccgatcccgatgctgagggtcaaagatacagtatgaacggatgttttttctcgaatttcatccaaaatcgaaaatttcgcgttttcaagctccgttaaaatgtgttcatttaacaccgcgataaaccgctcagaggacgtccgtttcaggaaaatgccgtactcctgcgcccacgcatttaataatgaggtgacctggctgttcatcgtgcttctcgtttggtcatccagcccctgtgtgacgtcatcatagttatctaaaaagatatatgccagcacggttctctcattttcgtactgcttttcaatctgaatctgttctgtcacatcaaagaaatagagcaggcgctcatctcttttaatcactactttaaacttccgctcattcaaggtgatcgtttccgaatcgacctcctgcttgatcagcggcacgacggcctcgcatgtgtcatacagcgagcgcccgacgagtgtgctttcattaaaacaggaagacaaaaacggattcgcccactcaatgtaatattgatcattaaacagcataatcccgataggcatttccattaatgcctcttcgcctacttttttcaatctatacgataacgtggagatataatcgtcaatttcttttctgatcagagaatccgcacgcttaatgaaaaacaggatcacggcgagcagcacaacgccgatggctcctatcagccagttaaagtaaatgctgatgaggattatgatgattgacaatgcaatcaatgcatagatgggataccgaaacaacggtttttcataaaaactaggcatttctatcaactccccacctgtaagtcacactcaatttcgcgtcaccttatttcttatgttaaagcctatgtcaatgatgcctaagaggagatacacggacaagatgagcggaaaaagcacacccagcacaattgctaaaacaggaacggctttcggcatctccatttcgcggcaatagaaaaaaataaacgctaatccttgaatacaaatcagcaagctgagaataaatcccccattcaatgaaaccgaatacagcatatgccctttttctaaaggcagaaaccctaatatcgtcacaataaaatacagaatgacaacgctttgcgggagtttgagctctctaaaaggcttcatcttcggaagatcaggggaaaatcgccgtaaaagcggccttaccatagcataactgaggaaagaaaaaacgatgccggtcaatacgagcactgtcggaaaaagatattgaaccgtgctcagctgactttccatcagcttgatctgcttcccgaactgatctccgtaaccgagctgctttgacatggtttctgctaaagacagcgactcccgaagctgggacatggtggtatcgatcacattcatattaagaaacacgatgctgaccacaaaaaaaacgacgccgcacagcacatacgccatagcgccggcagcaaccgcatagccgggctgtttctttttaaaataatatcccatggcgattcccgtacaggcagccgtaaaagcgcctgtaagcccggtaaacgaacttacaataaagctgacaggaaggctggcaagccccatccataccccgggcttcagaccgtgccgaatggtgtaaagaatgatcggcagcggcaaagcaaagagaagaattgcccccagtaaagggaggtacacgaccaaaagggaaatgattgcaaaaatactgatcaaaatggcgccttctattagagcccttgtatttttcacttactcacctcaaaccttgtatcattcgaacatacgaatagaaaagagcagcttagacgactgctcttttgacgccgcaatgtctctttcaagacctgaattttccataaactctccaaaatacacgtatatattttaacataagtcgaaatcgcaagtaaaatgagcgcggacacccgcaatgttccatgtgaaacatgaaaacagacaaacggacatcccagtgaaagaatgcccgttgtatcagtgatcctgatcatccatgaaaccagaagtatctctgtttttctttttggtttttcgtacatataacaagacgataacgataagtaagagagtggtcgcctgtaaaaccccgctgctgaaaaggaagaagttctttatcatgtcccacatatagtttcacctctatttcgtatttcctttacattgagtttccctttctggaaacttcaaaacatcaggaacaacatcgggaccggggcatatgctgaaagtgaaaatgaaggataaaggagattcttacaccatgaccgagcggagaacattagcatggcatgaaacgttagaactgcatgagttagtggctttccaggcaaacggacttgtgaaattaaaaagaacagagcgggacgtaagcgatgccagattaaaacagctttacagattttccatccattcgctggaacaaaatctgcgtgaactgcttcctttcttccctgaagctcccgcttttcgtgaggatgaaacagaagaacgcgctgattcctccttttacagcggcggcctgctgatcatggccaaaacgtctgtccgcaattacgccggagccattacagagacggccacacctcaattaagacacgttttcgtcaagcacttaaacgcggccatcaagtggcatcaaatggtctttgagtatatggaagaacgcgggcaatatccggcttacaacctgagcgaattgctgaagaatgacgtgcgtaacgccagaaaggccatcgcgatgaaataaaaaaaagcagcaaggaatttaatcctttgctgcttcttatttttgagcggactgatcttgaggcgacgttttttcccggtatgcctcgagaaactcccggttggcatctccccatttcttcatttgcaaaacgatcggttccagcgacctgccgaattcggtaagagaatactccacctttggaggcacctgctgatatacctcgcgatgcacgatgccgtccgcctcaagctcgcgaagctgaagcgtcagcatacgctgtgtaatgctggggcaaatgcgccgaaactcattaaaccgcttttttccgccgatcatatgataaaacaaaatacccttccactttccgccgataacggaaagcgtcagttcaaccggacaaccttctttattcggatatatgttcatttttcatcctccatagtaccttttttgatactatatgctgattagcatctgacttacccagtattttactcgcaatcctcctcaccgctcaacaaaaatgcttctttttcacatcaatttttaaggttttgaagattacaccctccgcaagacgtgttaaactataaaaagattgtttacactacaaaaaaggacaaggagttattatggaaaaaattcttattttcggacatcaaaacccagacacagataccatttgctctgccattgcctatgctgatctaaaaaataaactcggcttcaatgctgagcccgtccgccttggacaagtcaacggcgaaacacaatacgcgcttgattatttcaagcaggaaagcccgcgtttggtggaaacagccgcaaacgaagtaaacggcgtcatccttgttgaccacaatgaacgccagcaaagcatcaaggatatcgaagacgttcaggttcttgaagtgatcgaccaccaccgtatcgccaacttcgaaacagcggaacctctttactatcgtgctgagccggtcggctgtacggctacgatcttaaacaaaatgtacaaagaaaataacgtgaaaatcgagaaagaaattgcgggcctcatgctgtcagcaatcatttccgactctctgttatttaaatctccgacttgcacggagcaagatatcgcagcggcaaaagagcttgctgaaattgctggcgtagatgcggaagagtacggcttaaacatgctgaaagcgggcgccgacttaagcaaaaaaactgtggaagaactgatttctcttgatgcgaaagagttcacgctcggcagcaaaaaagtcgaaatcgcccaagtcaacacagttgatattgaagatgtcaaaaagcggcagccggaattagaagcggctctttcaaaagtaattgctgagaagaaccttgacctgttccttctcgtgattacggacattttggaaaacgattcccttgcgctcgccatcggtgatcaagcgtcaaaagttgaaaaagcattcaacgtgacgttagaaaacaacacggctcttttaaaaggcgtcgtatccagaaagaaacaagtcgttcctgttttaacagacgcgattgcagaataaccaacacaccccggcaaccagccggggtgttttttttatagctcgttcatcagacagccattcgtaagcgctttctccgaaaattattttgacgccttctaatatacaatatataatatatcacatgtaaggtgtttgttttcctaattattgtaagttgctatcgcaacatcagaatcgggggtgtctatcctggaaaaacacgctgctctttcttattcacgaacaacaggcatttggcttgtgcttacaggagctatcttatggggggtctcgggaacggttgcccagtatctgttccagcaccgccattttaatacagaatggctgacttcggtgcgccttctggtgtcaggggcgcttctgctcggaatcgcgtaccgcaaagaaaaaggacggatatgggctgtttggaaagacagccgggacagaattccccttcttttattcgggattttcggaatgttaggcgttcaatacacctacttcgcggcaattgagtacggcaacgcggcaactgctaccgttcttcagtatttagggccggcgatcattacatgctttttagcgattcgcgcaaagagaattccttcgggaaaagaactgctcgccgtcttattggcggttgccggcacattcattttggtcacgcacgggaatgccggaagcctgtccatatccggtctggccgtcttttggggaatcagttcggcgtttgcactggcgttttacacccttcagccgcatcgtctgctgaagaaatggggatccgccattgttgtcggatggggcatgctgatcggcggagccgccctcagcttgatccgcccgccctggacatttgaaggcgagtggtcctttcctgcatatgccgcgattgtgtttatcatcattttcggaacgctcatcgctttttattgctacttggaaagcctgaaatatctgagtgcctctgaaaccagcctgcttgcctgtgcagagccgctgtcggcagcttttttagctgttatctggctgcatgttcccttcggaatatcagaatggctgggtactttgctgattttagccaccatcgctttattatctatcaagaaaaaataacctctcttttttagagaggttttttcctaggcccagagcaccccttagtctcaattacccatatattaaaaggccttttttcattttactatcatccaaaagaggaaaatagaccagttgtcaatagaatcagagtctaatagaatgatgtcgacaagtaaatcatgcaggattgttactgataaagcaggcaagacctaaaatgtgttaagggcaaagtgtattctttggcgtcaccccatacatattttaggtctttttttctgtaacaaacctgccatccatgaatgcaggaggatcgaatcggcagatcgcaaaaaaaggtacatacaaaaggagacatgaacatgaacatcaaaaaatttgcaaaacgagccacagttctaacttttacgactgcacttctggcaggaggagcgactcaagccttcgcgaaagaaaatacccaaaaaccttacaaagaaacgtacggcgtctctcatatcacacgccatgatatgctgcagatccctaaacagcagcaaagtgaaaaataccaagttcctcaattcgaccaatcaacaattaaaaatatcgagtccgcgaaaggactggatgtgtgggacagctggccgctccaaaacgctgacggaacagtagctgactacaacggctatcacgtcgtgtttgctcttgcgggaagcccgaaagacgctgatgacacatccatctacatgttttaccaaaaagtcggcgacaactcgatcgacagctggaaaaatgccggccgtgtctttaaagacagcgataagttcgacgccaacgatgaaatcctgaaagaacagacacaagaatggtccggttctgcaacctttacatctgacggaaaaatccgtttattctacactgacttttccggtaaacattacggtaaacaaagcctgacaacggcgcaggtaaatgtgtcaaaatctgatgacacgctcaagatcaacggagtcgaagatcataaaacgatttttgacggcgacggaaaaacatatcaaaacgttcagcagtttatcgatgaagggaactatacatccggcgacaaccatacgctgagagaccctcactacgttgaagacaaaggccataaataccttgtattcgaagccaacacgggaacagaaaacggataccaaggcgaagaatctttatttaacaaagcgtactacggcggcagcacaaacttcttccgtaaagaaagtcagaagcttcagcaaagcgctaaaaaacgcgatgctgaattagcgaacggcgccctcggtatggtagagttaaacgatgattacacattgaaaaaagtcatgaagccgctgatcacttcaaacacggtaactgatgaaatcgagcgcgcgaatgttttcaaaatgaacggcaaatggtacctgttcactgattcacgcggttcaaaaatgacgatcgacggtattaactcaaacgatatttacatgcttggttatgtatcaaactctttaacaggtccttacaagccgctgaacaaaactggtcttgtcctgcaaatgggtcttgatcctaacgatgtaacgttcacttactctcacttcgcagtgccgcaagccaaaggcaacaatgtcgtgatcacaagctacatgacaaacagaggcttctttgaggataaaaaggcgacatttgcgccaagcttcttaatgaacatcaaaggcaagaaaacatccgttgttaaaaacagcatccttgaacaaggacagcttacggttaacaactaataacaacaaaaagaaaatgccgatacttcattggcattttcttttatttctcaacaagatggtgaactcaatcatggctcgaaaatggcccgttgtaatattgatctttttgggtgcgttcctgtttgtcggcttactgccgaacaaaacccacaattcctctgacacaaacacggagcataagaaggattaccgggcggcgtatcattttacgaccccggacaaatggaaaaacgaccctcaaaagcccatttttttcgaggggaaatatcattactactatctttataatcgggattacccgaacggcaacggcacagaatggcggcacgccgtatcagaggacttggtgcactggacggacgaaggcacggctattccgaaatacaccaacgaaaacggcgatatatggtccggttctgtcgtcattgataaacacaacacggcgggcttcggcaaaaacgcgctggtcgccgtcacaacgcagccgactgccaaaacaaaagcccaggaacaatatttatggtacagcacggataagggaaaaacgtttacttcctatagtgatcagcccgttatgaaaaacccgggaactaaggatttccgggacccgaaagtaatctgggatgaacaggatgacaaatgggtgatggccatggccgaaggagaaaaaatcggtttttatgaatcacccgatttaaaaaattggaaatacacgggcggctttatcactcagcagatcggcctcgtcgaatgccccgacctttatatgatgcgtgcagatgacggaacagccaaatgggttctgggcgcaagcgcaaacggcaaacccgcaggcaaaccgaatacgtacgcgtattggaccggaaactttgacggggaggaatttaccgccgatcaagaagaaccgcaatggctcgattacggctttgactggtacggcggcgtcacatttgaagacggtaatagcgaagatccgctgacaaaacgctatgcgctggcatggatgaacaattgggattatccgaatgaaacaccgacactaaaaaacggctttaacggcacggattctatcgtccgtgaaatccgtcttcagcagcaggacggcggcacatacagccttgtgtcagagccggttgaagcattgaaccaattaacctcttcaactgacagcatagaacacaaacaggtgaacggttcagagacactgccgatcaaaggtgacacatatcagcttgatatggatatcgcttggtcagatatcaaaaatgcaggcgtcagactcagagaatcagcagaccaaagccggcatattgatgtcggtatttcagcagaagacggctgtgcctatgtgaacagatcgtttacagaccagcctgataaaaccggcgcatacgtcgaaagcaaagccccatttgacggaaacaaagggcgcgttcatctgaaaattctcgtagataaaaccagtattgaagtatttgcagacgacggaaaaaccgttttgacaaatgaagtgttcccaaaacacgaagatcagggaatcacgctcttttctgaaggcggctccgctgactttcagcatattgagatgaagcatctcggttcgattcatccttagacgtccctcttcatttctaaccggcgcccggactgtggtaaaatgcaaatatgtatactacgattcatgaggtgttccattggataatcaaaacaaagaacctgtgctgaaaagaaccatcatgcgggacgaagtgtatcgcacactcagaaactggatcataacgggcaagctcaaaccggaaacaaagttaaaggacaaggatttgtcggaaacattgggaatcagccgcaccccgatacgggaagccttattgcggctggaagatgacggcttggtgataacaaaagcgaacagatggacgcttgtcgctccgattgagttaaaagaagcggaaaacttgtattccatcgtctggacgcttgagaaactcgcattgcagcaagccctcccgcgtatggacgatgccgtgattcaagaattgaaacagctgaatgaaaatcttcttcaaacgatgaaagacggcgataaaatggccgttctggaagcggataatgcatttcaccatcgcatcattctgcttgcggacaacgctgaacttcacaaattgcttgtaagcctgaaagtcaaaattcagagactggaaatccgctatttcagtgaaaacggcgctttaaacagatcatataatgaacactctgatatcattcacgcattagaacagcaagatgccgccgctgcttttacagcgcttgaagcgaattggaaaaacagtttagaacggctgcaaaacatggcatagcaaacgaaaaagccaaatcactcatatgatttggcttttttacggatatcacaagacagccgcgtgggctgtcttgtttactttttgtttatatataaataaataccgtaatccgtcggcacagaagcataccccatctgtctgagcatggctgttatattcccgcgatgatacgttccgtggttcacaacatgtaggatcatatcggcagctgcggttttcatgatgtcacctgacggatgctctatttcaagggggagactgatattttcctccttctgcaaaaatagttgataccggtctgataattccaaaaatagatcttccagctcttctatctctttagacaagatgtcccctttttgctgttcagctgatttcagcgtatcctccagacgctctccggagaacacatcaaaccaccccttatcggacagatacacatgagtcaatacaccggctatcgacggaaagacactttgaatctccttacggtacacatcctccggaagctctttaagccgggtgaatatttgctgatttgcccaaagatgataatcatacaattgcagtgccagatgtcccacattaccctctcctctctcgatatagaacgtacgttcctaattatactatactacatgccgctctgtaccattttcttcattcgcaactgagaaaatccgataaaagccgaaattaataagagaaggcctgcgccaatataaataaaccgcacaccgaatacatctgagataatccccgttccgataatggaaaacataaaaatgaactgaactaaagctgatctcgccgctaatatattgacccgtgtcttttcggtcgtgatgttttgaagtaatgtttcctgcgtgagatctcgtaatacacaagccggccccatacacagcaccagaaaaagggccgtaacggcgcttgtgatcagcccgtaaataaacgtgaacattccatatgccaaggctcccgtcagcataagcggaatgagatgatgctgaaacttaccggataacttatagatgatcagtcctccgatcatcgtccctgcataatagactccgttgacatacccccaccaagcctctcctttatgaaggacgtcatgcacataagtcaaggacacagacccgatccatatcatgcctgcccacgattcgatcacatccatcacaatgagaaccctgagctgtttttgctgaaataaatacacccagccgcttgccgcatctgcaaaaagggaacgtttcctgactgctgccggcgcacacatgcgtactcgaagaaacagaatgatgcccaacaccgaagaaaccaataacatgacagtgacgatcattgtatcgctctctcccaggaacgctatgatgacgccgcccagagaccaccccgcaaactgaacggtctgatccgccgcagataataaactgttcgctttcgcccttcgatcaggaggaatgatttccccaatcagcgcgctttttatcggagcaaaccatccgttgcaaaaagaaatgcctccgatcagacaaaacagcagaaaaaagaatgcggatgaaccggtttggatgacaaaaaacaaacagactaacagtgtgatctgtatcaattgagaactgattaacaaagaacgaagcgtgaaccggccggtgaccagcggcaaaacggcgctgcccaatacgcggcatacaatgctgacgagcgtcataagagaggccatcgctgtcgaaccggtttttgtaaacaaaaacaagataacggccatcgtataaagtgaaaaccccaagttgatagcggtctggctgtataaaatagcgtaatacgctctcttcgtattcatcctctgcaaccccactccctgattatgtaaatcataccatatttgccgatcagctttttttaaaaaaacagattgacatggagtccgctccatctatttcagcaaataacaattaagaaggagtgacagctgatttgacgcttggttcaactgaaaattgacataaggatatatgtgttgaaacgagctgatcacatccggaaccatactcattccaagcgactgcaatccattgcttgcccccgctgatttgacattccccaatctatagtgatgtatataagaaatgattttcaaaacagaataaaaaaagagggcttcctttccggaagccctcactccgtctgctacgccaataaaagaaaaataagcgctaaaacagccggaagtccttgttttacgataattgatttgtttgaagtaaagcctccgaaaatggccgcgatgaccacacaaataacgaaaaacatttgaatcatatggccaatcggatcagctccgaggatcagtccccaaatgaggccggcagccagaaatccattatacagaccttgatttgcaaacatgaccgccacattccgatcaccttctaaatgcttcggcaatttgaaagaccgcttggcagccttcgaattgataaaaaacatttcaagtatcatgataaatatatgttctaaagctacaattccgacgaaaacagccgcaattatgtccactgtccctctcctctcagcttcacttcaaccttatttccattgtgcgattgtttcgataggaagacggtaggaagcatatccttcgtctgccgcttttccgattgataacagcatgaccggtacataacgctctttatccattccgaaaacctcggcaatcttttctttatcatagccgccgatcgggtttgtatcatagccgtgcgcacgtgctgtaagcatcagctgcatggaaacgagacctccgtcgatcagaatcgtttcacggttcacttgctccggcagtttttcaaaatgcgccgtcaaagcagcgatttgtctgtcttttacttcctgcggcatgtagcccagttcgactgctttagaataaatttcttctaaatagtcatcactgttcatatctgcgaaaaccgcgatcaccgcagatgatgtgctgacctgtgtttggttaaagctggcaagcggcgcgagtttttcttttccttcagggctgtcaatgacgaggaaacgccatggctgcgcgttgactgaagacggcgctgtcgttgcttcttcaagaatttgagtcatttcttctttgctgatttttacggccggatcgtaattccgaatggaacggcgccctttcataatgtccataaagtcgtttgttttcagttctgttttcatgtgtaatacactcctatgctttcatattttctatattattctgcatctgcgacaatacgttttttaacatattgcgttcttcctcgctgacaccggcaagcatttcctttatgaaacgctctttctcctttttggaagcctcaattctctcccgcccctgatcagtaagccggacaagtataattcggttgtcctcgggcttccgccttcttgtgaccatttctttggcttcaagctgtttcaagtgtcttgtcacggctgcgccgtcaatattcacctttttctgaagatcgctttggctgatctcatcgacgtaaaaaagcacggcgagaagctcaaggcgggattggctgattccggtgcacgcttcaaacttcgtgccgatcactttgtgcagtgattgaagctgatacaaaatctcgccttcctctgaacaacatgctgtcaaaacccatccctactttcttttgcgcaattaattgactagtcaatgtttgatatatcaataatatacatccgttattctttttttgcaagtgttttctccttttttaaaaaaagctgccggtgaacggcagctccttcttaatgattatggatttttctgaaattactgccttttacttcagcgacatcatataccgtcacaaaggcttgattatcaatgtcattaataatttccttcagtttggtttcttccaaacggttgatgacacatgtgatttctttgaatttttcatgagaaaaaccgccgtatgcttctttatacgtagcgctccggcccaattcttcacgaatggtctctaccattaatgcaggctcgttggtgataatctgaaatgttttagaaccgcttaagccttcctcaaccacatggatcaccttggatgcgatgtagtaagcaatgacggaaagcaatgcgccttgcagcccgaatacaaaagaaacaaaaataaacacaaaaatgtttaaaaataaaatgagatcgctcgtgccaaacggcagtttccgtgacagaagcacagccagcatatcaattccatctaaggcgccgccgttgcgcaatgccaatcccattcccaagccgagaataatcccgccgacaacggtgattaacagggtatctccctcaatgatagccggcgtgtggtggaaaaaactcgtgcccgcggcaagtgagacaataccgataattgatagaaacgcaaaacctttcccgatttgcttatatcctaaccagacaaacggtatattgatcaccgcaatcaagatcccaagaggcaaatgaaagagctgtgaaccgacaatgctgagtccggttacaccgccgtcagatacactattcggaatcagtacggtttccagtccatacgcggcaataattccgccgatgatgaccatgatggcccgtacgattgatttcgctctgaatttcttacgtctttgtttttcgattgtactcatatcattccccgcttcaattattttgtcttatttaaatataccataattgatacttttcgttaaaaataagcctatcgactagttgaagcaggaaccgaggaaggagatttcacagataacgtatccatttatgactttaatcattcacaacgcaatcgttcagtaaaagggattatcatccattaatagtctcttttgtttcccttcttcacatattcccaatcatgctctatattttttctcacccgctgaagaaggctgaaaatggtttctttttcctcagacgtaaagccggacagggctacttccgcagagtgctctccttctctttgcaataacggataaacctttctccctttttcggtcgggaacagtttttttatttttttattttgatcatcaggacgcttttcaacaaatccttgtatttccagtttcttgatcgctctcgccgctgttgtccggtcaactttaatcatttccgccagtttttcctgtatcactcccgggttttcacatatacgcacaagatagagatactgcccctttgttaagtctaattccttaaattcaatattgctgatggaatccaatgcccgtgcgatcatgccgatttcccgcaaaatatcagtcatatcttttcaaacctttcatgtttttgttgcatttgcaatataattgttttatcgttacttctataagaccacaagcaagccgtgcagtccagattaatatgtgaaaaggattgattgatcatgaggataataagaataacaacggaaattgatttgcaagcagcgcttgagattagaaaagcagtattcattgaggaacagcaagtacctgaatccgatgaatttgatcagttcgatacgcttgaggaacagtgcgggcatgtcttggtttatcatgaaaatcagcctgccggcacaggacgggtccgcatcgtaaaccatacaggcaagctcgaacgaatctgcatcctgaaaccttaccgcaaatacgggttaggcaaagtaatcataagcgaattagaaaacatggtaaaagaaaaaggcatcacccaatgtaaactgcatggacaaacacatgcggaaggcttttatcacaaactgggctatcagacagattcaccggaatttatggaagacggcatcccgcatgtcttaatgacaaaagagctggcttaaccgaataacaaacggccggacttcttcctttttaatctttagtatattaaggatgcaagattgaccgaagttaaaggaggttagaatattctgatctcctttaactttctcatctatctctgccttgccactcactgcatcccgattcgccaagtttaaaacgaaccatgcagtttgaattccgatatgccgctgtcttttaaatttgtctgcttgccaattccttaatcatcaaacccaattcataaattcccttttgaaggtcttcaagagatgcataagcatatgataagcgaatataattccctttttcctcagcatagatactgccgagattgagcagaaccccttttgataaggctttggtataaagtaatttcatggatatggaaggcaatatttttacccagacaaagaatcctccttttgggatattccatgtcgccacatctttcaaatgagtttctaaaacactcaaggccaattctcttctcacctttaattgacttctcacctgttctagatgctgctggtattcaccggatataaaccactcagccgctactctctgggataacgaactggagccgtaatctgtttgcatttttatgtcggataaacgttcaatcactggttccggcccgacgatccatccaatcctcaagcccggacttaatgttttcgataagctgcctatgtaaagcacatgcccatttttatcaattgttttaataggatctggaggaatctcatctatccataactcacgataaatgtcatcttcaataatgggaagctgtgtattctcacttgccgcaaggatttcttctcgtctcttttttgacattaaaatacctgtcggattatgaaaacaaggatttgtatataagatagccctcccccgttccccccttgccatgcggatatgttccggcaaaagtccatcatgatccataggaactccagtcagcttcatcccggctgattgaaagacgtgtaatgaataaagataggaaggctgatcaagataaacggtcgatcccctttgtaaaagccccattgatataagctgtaaggcttgcagcgctccagaaacaataagaatggaagaaggagaagcttgaatgccgattgttcttaaatagccgcttaatgcctctctcaaaggtaaatatccttttggttcctcatatccgaatgcctctatgttttgagatatctttcccatgatctctttcataacagctaaaggaaaaatctcatgtgaaagttctcctttactgagctgtataagatcagaatttgattctgatttattgatctcttgaacgattttttggcttggctgctgaattccggaggttacatactgatcccaatcgggggcggaattcttagccaaaagtgtccatgtattgttcgtaacaactgtccctttgcccattctgccttcgattaatccatccgccatcaattcctctaaagctgtaatgactgtgctcctgttcacctcaagttgtttggcaagcgtgcgctggcttggaatcttacttccgatcggccattctccatttcctattttctcttttataaattgaatgatttgtatgtacttaggaagctttctcatctttttttcttctggagcgctcattaaaagggtcctccttaaaaactaaagtggttgggtcaaaatctatttaactggttgaagtcatctcatcaaatctttattaatatagaaaaacattaaataactggttggtttttgtaaagaggagtgagaaagatgagaaagaaaacagttcgaatcggcatatcttacagtctgatgattgggttgtgggcatcagctttcccgggaattcgcgcgggtcttgagagttacacgccggaacaccttgctttgtttcgcttgttgattgggtcaatggcactgctggtttttgctgttttgactcatatgcgtttacccgacatgaaggatatccctgctattttatcgttaggatttttaggttttgcactatatcacattttgctgaatatcggagaaaaaaccgtcagcgcaggggtagcaagcttactcgtgaccatgacacctattttttctgcaatgttatctcgtctgttttttggtgaacattttgggctttataaatggattggctctatcataagtttattgggtgtgtcgatcatttctttcggggcaggaaactatacaaattcagtgaacggcattttgttaatcctgctggcagctttttcggagagtatttatttcgtttttcaagcccgctatataaaaaagtatggttttattccatttgtgacattcaccatttggggtgcaacattgcctatgctgatgtttcttccgggattatggggagaagttgttcacgcatctatgaattccacattgtctatcgtttacttaggcttattaccaacggttgtgccttactttgcacttgcgtatgtcacttcactcgtcggtgcttcagaagcagccatttcactttatttaacaccagccataaccttggtcatttcttgggtgtggttaggtgaagtacctgcgtttatttctcttctgggcggcgcagttacagtcgccggggtgtgtttcacttatctaacagtaaataaaatgataaagattttaaatccttatttcttatctaaaaagcaataaagtggatgacatttaaccctgaaaatagagtcgtaagccgttctcctttttaatgacttgggtttggatcacaaagttgagtgtatgaatttttttagaggattgtggtatgttaaacatacaaatatgaatagaaagcaggtgagcccatgccaaacaatagtaaacccaacagtttaatcacggagaagtccccctatctgctccaacacgcccacaaccccgtaaactggcacccttcgaaaaagcgaaacgcttaaacttaaacaagccggttcttgtcagcgtcggctattcgacttgtcactgacgccacgcagattaccatataatcctctccaattccctccattaaaatttttcgatccagaggggatgctttatctttaaattgctgaatattataatgttgataaaaccattttttacaggtttattaagacaaatgaaagcagaaggattatgatcatgaagaattttttctctattggagaggtatccaggttatttcacgtcaaaatatccactctcagatattatgatgagatcggtcttttgaaacctgcatacaaagacaagcaaaataactacagatactattccacagagcagtttgagagactggatacaatcaaatatttgcgggctttaggcttgccaataaacaaactcctagatttttataattcccacaatgcagataccttaattcaattactgaaaaaccaaaaaaccgaaatcgatcgtaaaaaaagggaattagagcttattgaaaaaaagatcacccgccgtttaaacaaaatagaagatgccgttaataaaccgttagacaaaattacaaaaatcaaacttccggagttgcgtgtcgcttatttacagcatgagtatattctaggtcatgatattgaacactctctaacagaattgagaaatgatcttactattaaagaagacatatttttaggaaagattggattatcgatttcagtgtcaaacctaaaagcgcataagtttgatcgttactccagtatttttatgatcttagaagacgagcataatttgcccccatcagtaatcaccttaccatcaaatgaatatttacaaatcaggtttaaggggtcgcataaagaggccaaacaatattataaaaagttactgacatatatgaaaaagcatcatctggagttagcggccgactccattgagataacgttaattgattatggtgttactaataatccggatcattatgtgaccgaaatcatgctgcccattaaataatcccttgactctctagttactggagagtttatttttttaaaagcacactttattgggggagaaagcacatgattggaacaatttttaacacatttatgatcttcgcaggatgtttactcggagggctattcaagaaaggaatgaaaggtgaatatcaagatattcttatgcaagcgatggggtttgttgcagttggattaggaataaacgccattacacagcatttatcggatagtaaataccctattctttttattgtaagtttagctgttggcggactacttggacagtttgtaaatttggaacttagattcaaccatctagtcagcaagttctctaaaaataacttagctgaaggcttatcaactgcaatcttattgttttgcatgggatcattgtcgatattagggcctattgaatccgcgatccatggtgattccacttatcttcttacaaacggtatgttggatggcatcacttctattgttctcgcatcagcgtttggctttggaatagccttatctgctgttgtgttatttgcctggcaaggctcactctatttatttgcaaaagtaatggagagtgcattaagtgcagacatgattaatgaaataacaattgtgggcggaatactgatactaagctcggggttaagcattttgggaattaaaaaatgtaaaaccttaaatcttctgccatcacttatcattccgcctgttgttatctttgttatgaaagcttttggattaggcgcatagctctatatcagttgtcaggcaccttgtccattctgtcaactacagactagttttctttagacagaaacaaataaagaatagactgcacatctttatggtacagtaaagatatatcaacggtaatacgaacgaaagaaggtgatcccatgccaaataaaaaagtacccaatagattaatcgacgagaagtcaccgtacttactccaacatgcttataatcccgtggattggtatccttggtgcgatgaagcatttgaaaaagcgaaacgagagaataaacctgttctcttatctattgggtacgggtagcttagcgaacttgccactggtgtcacgtaatggctcacgagtcctttgaggacgaagagatcgccggtatgttaaacgataaattcatagccatcaaggttgatcgtgaggagcgccctgatgtggattccgtgtatatgagaatctgccagctgatgacggggcagggcgggtggccgctgaacgtgttcgtcacaccagatcagaagccattttatgcggggacgtattttccgaagacgagcaaatttaaccgtccgggctttatcgatgtgcttgaacatctgtccgaaacgtttgcgaatgaccggcagcatgtcgaggatatcgccgaaaacgccgccgctcatcttgaagtcaagattcacccggctgagggcatgcttggcgaacaggcggttcatgacacgtatcgccagctggccggcgggtttgatacggtgtacggcgggttcggccaggctccgaaatttccgatgccgcatatgctcatgtttctgcttcgctactacagctatacgggcaaggaacaggctttggccggcgtaaccaagacactcgacggcatggcgaacggcggaatttttgaccatatcggatttggctttgcccgctactcgactgataatgaatggctcgtgccgcattttgagaaaatgctgtatgacaacgcccttctcctgaccgcctatacggaagcctatcaagtcacaggtaatgagcgctacaaacagattgcgatgcagatcgtaacgtttattcagcgggaaatgatgcatgaagacggcagctttttctcagctttagacgctgataccgaaggccgtgaggggaaatattacatatggtcaaaaaaagaaatcatgaatcttctcggtgatgaactcggcccgctttattgcaaggtgtataacatcacagatcaaggcaattttgaaggcgaaaacatcccgcacctcattttcacgcggcgtgaggctatcctcgaagagaccggcctcaccgaacgtgagctggccgaacgtcttgaagaggcaagaacaaaattgctggaggcccgtgaaaacagaagctatccgcatacagatgacaaagtgctgacctcatggaacgcgctcatgattgccgggctggcaaaagccgcaaaggtatttcacgagcctgactatctcagcatggcggaaacagccatccgctttctcgaacggcacctcatgccggacgggcgcgtcatggtccgctatcgcgagggcgaagtgaaaaacaaagggtttatcgatgattacgcttttctcatctgggcttatcttgaactgtatgaagcgggttttcatccgtcttatctgcagaaagcgaaaacgttatgtacaagcatgctggagctgttctgggatgaacggcacgggggtttcttctttacggggaatgatgctgagacccttcttgtcagggaaaaagaggtttatgacggggccgtgccttccggaaacagcgcggctgccgtacagctgcttcgtctcggccgcctgacgggtgatgtatcactgattgaaaaagccgaagtgatgttttccgtgttcaaacgggaaatagaggcctatccgagcagcaacgctttcttcatgcaaagcgtactggcacacacaatgccccaaaaagaaatcgttgtgttcggaaggaaagatgacccggacagaaaacgtttcattgaggcgcttcaggagcatttcactcccgcctatacgattctcgccgcagaacatccggatgatcttgctggcatttctgactttgccgcaggttatcaaatgatcgatgggaagacaacggtctacatttgtgagaatttcgcctgccggaggccgacgacggatattgatgaagcgatgaacaccttacaaatcagcagcagagcctaggcggcctgctgcttttcttttttcacaaaacggaatgcgagccatgcgaagatgatattgatcaccagagtcgatatgcaatcgtatatttcatagcccccggctgctgttgtaaataccgacggaatgccgccgtacaccgaatgatcctctgtgagaaagataaataaaaacatattattggcagcgtgaccgccaagggacatctccagactgcccgttttaatcgtgataaaggtccagatcatgccgatggtgacatatccgattcccgcccatagagccccattatccatctccggatttccgaaatgaagtgcgccgaataatccgccgataatgatcgtcagaaccaccgcgtttgccgtcaattttccggcaaactgtagcagaaaaccgcgaaagagaaattcctccgcagaggtttgaatcggaaccaacaagacggccgccgctaacagcagcagaaaacgtgaagcatggaattcctgaagcgtgaaacgatccggatgaattaaaaaatcaatcagccccgcgacaaacatcagcacaacatatgtgccgaatccaaagaaaattctcttccagttcagcgactgattcggtgtaatgatggataaaaaccgccgcttcataatgaaacgaaccgctatccaaatgcccggaatcgctatgaaatagacgatatgctgtaaataaatatccgccagcgggtcacttaatgccgcctcatcccaatttatcgtcagtgaaggattgaaagcggacgtgagaaacatataaaacacggtcagtatgcttccgaaaaagaacaaacccacaatgagcaacagagaaagaagatatctcgatacactatttcttccctctgcgggccgtacaaatgtattcatatttatgcatcaacttcctttccttcaacattttacaatataaacagaaacagatataggaaatgttatatattttaagaagaaagcgctatgccgtttcctttggctctggttatttacactctgtttttgccaaaaaaagacctttataatgtattcgtcagataaatttacagtattttctgattacaattgctaagtcagggggttttttatgaaacatcagacattctcaaatgtagcgaaccgattagaccgtctccccatttcgcgtgtgcactatcaagtattaaccgctctcggaatcatctattttttcgatctcgctgacctgtttacgctcagcaacgtggctccggcgctgattgagcattggggcgtgaagctgtccgtcattgccgacatcacggccgcatccttcctgggcatgtttttaggcgcctccatcggcggaaggctgtccgatcggatcggcaggaaaaaagcgctgaattgttttgtccttgtcttttcgatctcatcttttctgaatgcgctggcatgggacattccttccttaatgattttccgcttcttgaccgggctcggcgtcgcggccgccatgattgtgacgaacagctatttggcggaattttttccatcatccgtacggggaaaatacatctccttttgcgccatgatcggactgatcggcgttcccgtcacaaacgttgtttccgcttttgtcattcctttaggctcatgggggtggcggctcgtattcgtatggggggcggccggtctcatttatttcttttttatccgccggcttgaggaatcgccgcgctggcacgaaaatcggggcgcatatgatcaggcaaacgccattatgaaccgtcttgaagcacgtatagagaaagaaaaaggcccgcttcccgcgccaaaagaggcggcagaagtacatacagtgaagcacgcaggctacttagggctgtttcagggcaggaatttaaagatcaccatcatcctgtcagcggtatggattcttgaaacctttggcttttacggctttgcttcatgggtgcccagcctgctgaaaagcaacggcatcaccatggaaaaaacgctgtggtacaatgtgcttcactctgtcggcgcaccgcttggcgcattgctcggttccatgatatccgagacgttccaaaggaaatggattctggccgcaagcgcttttctgactgccattgccggactgttatacggcatgacgtttattcccgtcatgattattgtgtttggatttgtcgtcaacgtcacggaacgggtattcacctcaaacttatacgcatatacatcggagccgtatcctacggaatatcgctcggccgggagcgggctggcgtacgggctcggccgtttttccaatatattcggctccctgctcgtcggatttattgccgttaagctcggctacatcagcgtctttttgttcatcggcggctgctggcttctatgttccgttttgttaatcctcttcggtccgaaaactaatgctcagcaaatttaatcaataaaacagtgcgggttccccgcactgttacactgtgatttctatcaaattgccttccccatcctctatcacgctctcataatatccgtcacccgtcacccgcgggccgcttacaacctgaaatccgtcgtttttaaacgtctccgtcaattcattcacccgctccttgctgcctgtagaaaatgcgagatgcgcccatccggtcatattctgtgacggagcttcatcaatgccgccttttttcataagttccagcctgcatccggagtcaaacgaaagaaagtacgatttgaaatcttttttctcattatgataaaggtcattggccttggcgccgaagtatttctcataaaattctttcatccgttctaaatctttcacccatatggccgcatgttcaattcgcatatgtccgcctcctttttttctcaatctagttataaagcatgaaacccatttcagttcaagactttttccgctgaaattgatgcataatttgttttttagccgtttctccgtgcaaaaacagcaaaaatgcttcccttccgacccgttccaaatgaagttccagagatgggatattcaatgcccggctgacgctcagatttccctcgccgatgatctccgcgtcccatttctgttctttcgcaaactggtacaagccggcagccacgtcatcactgtgcgcatagatggccgtcggcgccttgtcgaaaccccagaagtgttcacctgcccgctttccgtcgtccatatcatggcatccgatcagaatgcgggtttcatcaagagagccgaaaaccgccttatatacggttaccttgtcggccgtactcgggcttttttccgcttcccgcacacatgtaaaagcaacgtcttgatgtccgcggtttttcaaatacaaaaagctttctctgtaagctgcctgcctgtcattataagcgcagggaatctcttgatgctgcgtatattcacaagcgacaatggggccgtattccaggtaaggcacagcggtttcccattcattcgcgcgggacgtgacaatcagtccgtcaatctttttcattttcagcagttcgaaataggtcatctctatagcgaggtcatagttggtggggagaagggttgtcacgtaatcatgggcaaacgcttccttcgtgataccgtttacaattttgtcaaagcagggatggtcactgtacggcaatatcacgccgatcgtattggtctttccgcgaatcagatcaatggcagttcgattaggggtataatccagctccttcatcacttgattcacaagacgccttttctcctcagatacgtacgggtgtcggtttaatacgcgtgatacggtggccaccgacacattcgccagtttcgcaatctcttttatatttgccatgtgctcctccattttcggtgataaaaaagcagcaagagtggatttctcttactgctatctcatcataaatccactgtcatttcaacagggcaatggtcagaacccatgatatcggcacaaatggccgcttggctgatccgcggcttcagtctgtctgaaacaatgacgtaatcaagccgccagccgatgtttttctcacgtacgttcgtcctgtaagaccaccaggaataggcgccttcccgatcaggatataaatagcggaatgagtcggtaaatcctgtgttcagcagggcgctgaacgcttcccgctcttgatccgagaaaccggcgttcttccggttggctttcggattttttaaatctatctccctgtgtgcgacattcagatcgccgcataatatcacgggcttcttccggtcaagcttcttcagataatccttaaaatcggcttcccattgaagacggtaatcaattcgctctaatccgcgtttggcattcggcgtataacagttgacgacgaacacgttctcaaattcaagtgtgatcacccgtccttcttgatcatgatcgtcaattcccaatccataaaacacgtgaagcggcttttctttcgaaaaaacagccgtgcctgagtagccttttttcaccgcatagttccaatagccatggtacccttcaagctgtaatgatacttgtccgtcctgtactttcgtttcttgcagacataaaatatcggcttccgtttcctgaacgtaagtattgatatctatctttttcatcacagcacgtaagccgtttacattccaagaaatcagtttcatgtgttccctcctgtccggctcagccgtcattccagtgtttaaatgtttccgccctctaatgccagcagctgctttttcatttctaaaccgcctctgaatccggtcagtttcccgttttttccaatgacgcgatggcacggaaccgtaatcaataccggattttttccaatcgcggcgcccacggctcttacggctgccggtttctgaattatttttgctatatccgaatacgagtatgtctcgccgtacggtatgtccataagcgctttccatacagcaagctgaaattctgtcccgtaaagatccaccggcactgaaaaagctgatctgccattttcgatgtactcggacagctctgccgtgtaagacgccagcttctcatcatcacgtgccaatcggtattacggcagtgatttttttgcccactgctcaagctcttcaaagcttccatgatttgaacctataaagcatagccccttagatgtggcggctgtatacaggctccaatcattccgtgtgaaaagtgtccaatagaccattgtctctttactcatattgaacctccctttcccattccggcagtttttcggtattctgtgggcgaatttccggttctctttttaaaaagagtggcgaaatgcgctgtgtttggaattccgaccgtcagagcgatctccatgactgtcatatcagtatgctttaaaaggtgttccgccttcgacaatcttcttttctgtatatactcaatcggggatattcccctgatttttttaaatgtccgctgtaaatgataagggctgccgtgacacatttcggccagtacactcagagtcagagattcgtgataatggcggtcaatgtactcaatgatttgaacaatccattcttcatcaggaagacgaagaccgttcggccggcaccttttacagggacgaaaatgtttctcgagcgctgcatcagccgtatcaaacaccagcacgttttctttattcggaactctcgatttacaagaaggccggcagaaaatccccgtcgtttttactgcataataaaatgccccgtcataagaagcatcattgcgtatgattgcgccccacttttcatcagtcaggatatttctgtctgtctccatctcagccaccccctgttcttcagtataaacaaattcattgcataagtacgcgtatttgaatagaggagcaagataacaaaggagtaagaagcacttccatgtttcatgtgaaacatttcggcaggatggaggaggactgatataaaaaaagagcaggagcccgcaggctcttgctcttttctttcggcttactcgccagttacgtatggaagtaaagccatttgacgtgcgcgtttgattgcgatagtcaatttacgttggtatttcgcgtttgttccagttacacggcgaggtaagattttaccacgctcagaaacaaactttctaagaagatctacatctttgtaatcgatgtgcgtaatgccgttagaagtgaagtaacaaaccttacggcgtttcgcacgaccgcctctgcgtcctcctgccattgtcatttcccacctttctcgttatgaatatagcgataatctattagaacggaagatcatcatccgagatgtcaatcggcttgccgtcgttggcaaatggatcatcattaaagctgttcccttgatttcgtctctggttgttctgatttccgccgaacggattatcattttggcctccgccaaagtattggcctccgccgctgtttccttcgttgtatccgcctgatccagaaccgccgctgtttttaggctcaagaaattgaacactttcagcttggacttctgtcacgaagacacgctgtccctgctgattttcataatttcttgtctggagtcggccgtctacgccggcaaggcttccttttttaagaaagtttgcaacgttttcggcttgtcttctccaagtgacacaattaatgaaatcggcttcacgttctccggactggttcgtgaatgtacgattcacagcaagagtaaacgtggcgacagccgcaccgcttggcgtataacgaagctctgggtcttttgtcagtcttccgactaatacaactcggttaagcatatgaaagaccaccttttaacattatatatttcaaattgcttattcttcttctttaacaacgatgtggcgaatgatatcgtcactgatcttagctaaacggtcgaattcagcaaccgctgcagcttcagactgaacgtttaagatttggtagaaaccgtcacggaaatcgttgatttcgtaagcaagacgacgtttaccccaatcttttgttccagtgatctccgctccgttagaagtcaatacgttgttgaaacgctcgataactgccttctttgactcttcgtcaatgttcggacggataatgtacataacttcgtactttttcatctgtttgcacctccttttggtctaagcggccctataatgggcaaggagcaataattctattactcacaagtttatattataccaaagctcttgtccctttacaactgtgtcctatacattaaatcggaaatgaatgacatctccgtcttggactacatattccttaccttccagacgcacttttccggcttctttcgctccggacattccgccgcctgccaaaaggtcttcataagcaaccgtttcagcgcggataaagccgcgttcaaagtcagtgtggatgatacccgcacactcaggagctttcatgccttttctgaatgtccatgcgcgcacttcctgttcgcccgccgtaaagtatgttgcaaggccgagaagagagtatgacgctttaatcagctgatcaagacctgattcttcgatgccgagctcctcaaggaacatttgcttttcttcgccttccaattcagcaatttcagactcaattttcgcacagacgacgataacttcggcattttcacccgcggcgtactcacggattttcgcaacgtattcattgtctgaaggatcagccacttcatcttcgcttacattcgccacataaagcacgggttttgacgtaagcaaatgaagctgcttcacaagcttttgctgttcttccgtaaattcaacggaacgggcaggcttttcttgttcgaaagcttcttttaatttagacagaatgtcaaattcaaaaaccgcttctttgtctttttgcttcgcaagcttgcttacacgcgtgatgcgtttttcgactgtctccatgtcggcaagaatcaattcaagattgatcgtttcaatatcgtcaatcggatcgactttccctgacacgtgcgtaatattgtcatcagcgaatgcacgtacaacgtggcagatcgcatcaacctgacggatatgagaaagaaacttatttccgagtccttcacctttagatgcgccttttacgatccccgcgatatcagtgaattcaaacgcagtcggcaccgtttttttcgggttcaccaattcagtcagcttttgcagacgttcatccggcacttccacgattcccacgttcggatcaattgtacagaacgggtagttggctgattcggcaccagcctgggtaattgcattaaataacgtcgattttccgacattcggcaaaccgacaattccagcagttaaagccattctttcatctcctctatatcaaaccatcatcgtataaacgtattgtaaacctagagcaattataaggaggttcataggaaaagacaagctgagaaaaaagcatttcccgccctctctctccttagattatccttttttaaccgctaccagacagtcaaaaagcgtacttcccattccattatcggaatttgaatcctttgtgagcatgttgacggagcctccgaatgccgcccacatgccctcatctatattcaccgtcttcgggtgagcctgcttcatgattttcaccctgccgcgcagacggccgcggtcattgtaaacctctgccgtatctccgtcttgaagagaaagctcttccgcgatatccggcgacaggtccacctgaatctgctgaagcttttcaataaacggcacgtgctgtgaatgattggagcgctgcgggtgaatggacagcagcgtatacggatatttccctgcaagcccggcgtcgtgataaacagactcctccggcacttccaattgagggaggccgctgtatcctttctcttctgccagtgacgagacgaattcaaattttccgctcggggttaaaaattgaaaatcactccacggaacctgttcgaccggaagcggcatatgtcctttttcctttaattgctcaagggtgattccttctttctccaaagaagggagccccatttttaagaaatcttccgtactgtaatcaaacagctccccgaatccgagacgctttgcgagttccgtccagatccagcggtctgattttgcctctccctgcggttccgcaagcttcttgccatattgaacatagtgatgatacatgctggaataataaatatcttcctcttcgaaaactacggccgtcggcagcacatagtcacagagcttcgccgtatcggtcatgaccgaatcaatggccactgtgaccgatgttttttcaaacgcttccttcactttttttgtattcggcacctgtgtcagcggattgccgcacgtcacgatgatcatctcaatcggcgggtcggctgcattcagcgcctcttcagcttgagtcatcatcgaaaacattctcgaacttttcttcaaatcaggacgagtgagctcggcctttgcaaagctttcaccgacttgcacatttccgaagtttgcgccgccgcctttgataccgacatttccgctcgccgcagctagagcgtcaatccaccgtatcgtcccgcccccgtttttatatctctgcatcccaagacccataaaagtggaggcgggaccgtctgcatataaatcggcaagatattcaagcacttctaaagacgtttctgttttctcaatgatctcctcaaaagaaatcgtctgcagaagcttgtctatttcctcaaaaccgaccgaatgcttttgaataaaatcagaatcggttctgccggtttggcataatatttttaaaacacccgccgcaagccagccatccatgccgggtttgacggatatataccggtcggcaagctttgcagtcgggttaaaaataggatcaatgaccgtcagtgtcgctccttttttcttcacctgctgcagatgatgatagaggtgcatattcgtccgggacacgtttctgccccatacgatcacatgcttgctgtgataaatatcaagcggtccatgcccgtaagaacgcccgaaatcccagcgctgcgcttcaatgccggaaccccagcaaatgctgcccgcaatctcggttacaccgccgtatccattgaaaaaacgctggtcgagcgccttcaaaagaccgttattggcgtagtcatgactgtgcagcactgcggcagtgcccagcgtctccttaatcaccgccattttttcagcaatttcatctaacgcctgctcccaggaaatccggacaaattcgccgtctttcttttttaaagggaaacgaagccgttccggcgcattcgttttcgtctccagcattctgccccggccgcaaattttcccttccgtaatgggatgattcgggtctccgtctactttcgtcacctttccatcctcaactgtcaccaaaaagccgcagctgtcccagcaattcagcgggcacgctgactgatgcactttgctcatcgggcctcttcctctcctctatatgaaaaagcatgagcgccagcccttatgatgtaggctcctcatgcttgacgagtacttttttcagctttctctcaaaatctcttctcggaatcatgacactgtgggaacaacccgtgcatttgatccgaatatccattcccatccgaatgattttccacctgttttcaccgcaaggatgcggtttcttcatttcaacaatatcattcaggccaaagtctttatccgccaagacccttcacctctctccatagactgctttatttattgtacaaaaaaagacaggataagagcaacggccgcactcaaaatgagcattatacttttttccatctccctaaaatagggtaaagaagaagacataccagcaaataaagacttaaaagcccgtaaatgggatataaaatggcgatcaaatctgaaaaaccgattgtcgtaaaaggcaccatcacagctaaaagaagagatacgagcgtccatctcggcaatttcacaaatgcaagcatgcggctggacagcccgaacagaccggtcaccgttgtcgtatagatggctaaaaaaagcacggcggccatacaaagaaataacggataaggagcgccttcaaggacggcgaaaagaggaatttcatattgtgtaagactgcctgaaagctgtacaagcgtttcattgtaaacaaatgaaatcataccgaaaatcagcccgcttgcaacgcttgcgattttcgcttctcccagtcccttcatatctttcccgattgaagaaagaacagcgacaacagaaaggatgtttaaggacgtgaaggtaatgcttgccggccaattatactggcgggtcaaatctatcgtccacgtgtaatgatgggttgtctgaaaaaagaccaatgcatataacagccccgctacaagaatcggtatcaaaatactattcagagataatattccttttatatcccaaaagaataaaccgacggttacaatgcaaagaagaaaaataccgatccaaaacggcagcttgtacatttgcagcgtcacaccgccgccggcaatcataaccatcgtcattgaaaacaaataaaacataataagcacatcatagactttagcaagagccggccccatcagatgctcaagcacaggtaaaaagtgcgttgattgaacccgatagctgatcttcaacacaatataagccgaaatcgtaaacatgactgtaaacaatacaatagccagtccgctttcgacaccgaaaaactgccatatttcctgcccgcttgcatacccggccccaatctggctgcttaatatgagcagcatccacttcatcccggctctccacaccctcatcacctcataaaatttctgatcatctccgcatattgctactatattgagtgacagcggcaaacattcatacaaatgggacaaatatggtatgataacgacgattgactattcagaaaatttatttatgttaggcgctcaaatcatggacatcaggcgtttaaccgcaagtgatacccgatatcaggctcaaagctttaaaagatcacccggacgcattcgccgtcagctatgatgaggagaaagaatggctgtccgaaaaatgcaaagccaggcttgaagccggcaatgccatcgtgcttggcgcctttgaacaagacagactgataggaatcctcaagatctccaagcattcgctgtttaaactaagacacattgcggttattggttctatgtatatttcccccaaacaccgagggtcaggcgcgggaaaagctttaatgacggaagccatcagccaagcaaaaaagatgaaagacacagaacagctccatctctctgtgacttcaacaaatgaacccgcaaaaaaactctacgctcagttaggatttatcctcttctctacagaaaaaagagcgctgaaattagatcatcagcaatatgttgatgtagatcaaatggtcttatttctttcatgaacttagagaataactgctctgggttctttttctatcccgctcttttcaaacaaccggcatgctgatcatgacataagcataaaaaaaggcagcgctggatatactgtaaacaaccatacatcaccaaaaacaacaatgtaatactcgtatgacatgacaaggaagtgaaccttatgaatcgaaaaggcgggcttttttctcaagaacgggcaaaacaatatgtatcccatacggattcttctgctgcgaatcaaatacaagcgatccttacttcatctttacgtaaagcagccggcagaccgttagtcaccgtgtgtatcggtacagatcggtcgaccggagattcattaggtccgctcgtaggaacaaagttagaaaaaatgaatttaggcagattgcacgtttacggcacgctgtcagatcctgttcacgccgtcaatatgaaagacaagctgaaagatattcaacatctacataaaaatccgtttattatagcggttgatgcttgtttaggccgcgtcaaaagcgtaggctcatttcaaatcggcgatgggccgctgaagcccggagcaggtgttcaaaaagaccttcctgaaatcggtgacgtccatatcaatggaatcgtcaatgtcagcgggtttatggagtattttgtcctgcagaatacgaggcttcatcttgttatgagcatggcaaatgttttagcagaggggttacagctgacagataaatcagaaggccggcaggaacggctcagtccgtttcataagctgacaagacgtatataaaaaaccatcttttaaataaagatggtttttacgcttctctctcggacaatagttccaggatacgttcaagatcttcatttgagaaaaactcaatctcaatcttcccttttttcttttgtctcttaatattgactgttgttccgaagtaattttgcaaatacgattcccgctcttttaacacaacatcttgaacaggttcttttttctttgtttcacgtggaacattgttgtttaactgctgaatcagctgctcaagctgacggacgttcagctgttcttcaaccactttcttcacaagcggttcaagcttgtttttatttttcaaaccaagcaaggttctgccgtgtcccatggataatgtaccttctgcaatgaggttctggatgctttccggcagcgtcagcagtcttaaatggttggcaatatgaggcctgcttttaccgagccgtttagcgagctgttcctgggttaaatccaaatgcttcagcagtgagtcatatgccagagcttcttcaagcggtgataagtcttcacgctgaaggttttccaaaagagcgatttcccgcatcagcgattcagataaatcccgcacgatagccggcactgtctctttaccggcaagttttgcggcgcggtaacggcgttcgcctgctacaatatcatagcccttcaatgattttctcacgataatgggctgaagaatgccatgctgaatgatggactccttcagttcagctaatgactcatcgtcaaattgttttcttggctgataaggattggggcgtaaatcactgattttaatctcttccactgtctcttcagacaaatcaacctgattaaacaacgcgttaatcccttttccgagcccgcctttagccattcgctgccacttcctttgctaaatctaaatatacttccgcacctctcgaacgcggatcgtataatatgatcggcttgccgtgactcggcgcctcacttaaacggacattgcgaggaataatggtttgatacactttatctctaaagtatttctttacctcttctattacttgaatgccgagattcgttctggcatcaagcatcgtcagaagcactccttctatcattaagtcggtatttaaatgtttttgcacaagccgaactgtatttaataattgactcaatccttcaagagcgtagtattcgcactgaaccgggataacgactgaatctgaagcggtaagcgcattaatcgttaataacccgagagacggaggacaatcaataatcatgtaatcgtaattttgtttcacagattctaatgctcttttcagcctgacctcccgtgagatcgtcggaaccaattcgatttccgctcccgcaagctggatcgtggccggaatgacatctaagttctctactgaagtcggtttaataatatctgtaacatctgcatcatctactaaaatgtcgtacacacaatgatccacatcggctttttcaatccctaatccgctcgttgcattgccctgcggatcaatatcaacaagaagaacccttttacctatgtaagccaagcaagcccccagattgacagaagtcgtcgtcttcccgactccgcctttttggttcgtaattgctatgatttttcccacgatgtcacctaccttcacatgaacatgtactgtcttgtttctatcttatcaaaaaaagagtaaagcgttttatttttttcataatttgtttatcagcaagtgaaaaaaatgtaaacgaaaaagacactttctaatataagttctccgataaagtgacttttttgactgtaaaaagataattcacgacacaaaaagataaaattttacatatataatgtatagtgcacaataaatctatcattatctcaaaatagttttttgattaaaataaaaactcccctgctgatcaggagagtttttatttaggtatccgaatggtaagctggatgtactcttcgaattcttcttcttcagtgttcagcctgacgccgctgtcttccaccatggacagtgactgacgaatcgtattcatcgcaattcttgtatccctgctgaacgctttgcgtctcggctttggtttctgcttattctgttcaagcattttcaccactctgtcttccgtctgcttgacgtttaagcttttctcaatgatttccgcaagcaatgtgacctgaaactccggctgtttgagcggaatcagtgctcttgcatgacgttccgtaatttttttctccataatcgcatcctggacgggttccgggagctttaacaatcggagcttgttcgcaatcgttgactggccttttcctaagcgctgcgccaaggcttcctgtgttaaatcatgaagttctaacagccttgcgtacgcatgagcttcctcaatggaggacaattcttccctttgcaggttttcaatcaaagcgacagatgctgtttccgtatcagaaaaatctttaataattgcgggaatcttctcccattcaagcgtctgtaccgctctccagcgcctttcacccgcaatgagctcatattgtccttcatcttctgtatgtctgacaacaatcggctgaatgatgccgtgtgtatggatagtcattgctaactctttgattttttcatctgagaaaatggtgcgtggctgaaaacggttgggaacgatagcatgtaccggtatttcgagtatctcttctttgtttgtatcatgctcagctatctccggttcctcttccttctcaccaaacccgaagaaacgagagaatgaatgcttcatgtacctacaccacctttaaaaactgccatttttataattctattttctcatggtttttcctgctgtatcttcatcaattttgcagaaaatatgatggaattgtcacatcaggctgtctaaattacccttcaattggcgatttatttggagtacccggttttctcggatattttttcggagtgcttttcgtcttgcgaatgatcataatgttccgttcactttcttcaacgggaagtgtaaaggaatgaacttgttcaagctctcctcccaatactttaatcgccttttgccccgctttcagctcttcatcagcggctgcagcttttagtgctgcaaatataccgtttttcttggccagcggcagacaaagctcactcaggactgacagacgcgccaccgcacgggccgtcacgagatcgaagctttcccggacgtctttccgctgtccgaatgtctccgctctgtcatggacaaatgtcgtatgctctaattgtaaagcatcagagagagtttccaaaaacgtaatccgcttattcagtgaatcgacgatggtgacatgcagatgcgggaagcagattttgacgggcaggcttggaaaaccggcgccggcgccgacatcacaaagagtggtgaccttttcaaaatcaatataaaatgccgccgttatcgaatcataaaaatgcttgagataaacttcctttttctcagtgatggatgtcagattcattttttcgttccattccacgagcatccgataatacaactcgaattgctccagctggcggtcagaaagggaaatccctttctccgctaaactggatgtaaattcctctatattcatgccgtcatcctttctattcagctaccttggcaatacggccctgctccaggtataccagcaggattgaaatgtctgccggattgacgccggaaatacgggacgcttgagcaactgataaaggacgcacttctttcagcttttgacgggcttcagtagcaattcctttaatggcgtcataatcaatccgatcagggatttttttgttttccattttcttcagcttttccacttgctgcaaggatttttcgatatatccttcatatttcacttggatttccacttgttccgccacatcttgcggaaccggagaatctgcaggcgcaagttttgtcactgtttcatagttcatttccggacgtttcattaaatctgtgccgcgcactccgtctttcagctcgcttccgccgagtgaacggatatattcctgattctcaggagacggcttgataataacagaccagagacgttttttctctgcctcgatcgccgcttttttcttctcaaacgcttcatagcgctcatcagaaattaagccgatctcgtggccgatttccgtcaggcgaagatccgcgttgtcgtgacggagcagcagtctgtattccgcccgtgaagtcagcagacggtacggttcattggttcctttcgttaccaaatcatcaatcaatacaccgatataagcatcggaacggctgaggatcacttcttcttttccaagcgctttgcgccctgcgttgatccctgccataattccttgcccggctgcttcctcataacctgatgtaccgttaatttgaccggctgtgtacaggttagggatttttttcgtctccagtgtaggccagagctgtgtcggtacaatcgcgtcatactcaatcgcgtatccggctctcatcatctgcaccttttccagtcccggaatggtcgccagcatccgctgctgcacgtcctcaggaagactcgtggatagaccttgaacgtatacttcctgcgtatttctgccttccggctcaaggaaaatctgatgacgcggtttatcattaaaccgaacgactttatcttcaatcgaagggcagtatctcggtcccgttcctttaatcataccggaatacatcggcgaacgatgcaggttgctgtcgatgatctcatgagtctcaggactcgtgtaagtcagccagcaaggcagctgatcggtaatgtattcaaccgtttcatatgagaaagcgcgcggaaccgggtcccctggctggatttctgttttgctgtaatcaatggaatcgcttgagacacgaggaggcgtgcccgttttaaaacggacgagatcaaaaccgagctcctctaagtgctcagaaagtttaatagacggctgctggttattcgggccgcttgagtaagacagatcaccgagaatgatccgccctcttaaatacgttccggttgtcagcacgaccgtttttgccttgtattcagcacccgtttgcgtaatgacaccgcggcactctccgtcttcaatgattaaacgctcggcaatcccttgaagaagtgtcaaattcggtgttttttccagcgtatgcttcatttcgtgctgatattggaatttatccgcctgcgcacgcagcgcccgtacggccggaccttttcctgtattcagcattctcatttgaatatgagttttatctatatttctagccatttctccgccgagcgcgtcaatttcgcggacgacaatccctttcgcggggccgccgacagacggattacatggcataaacgcaaccatatcaagattaatcgtcaaaacaagcgttttggctccctggcgcgcggatgcgagggcagcctcaacaccggcatgcccggcgccgatgacaatcacgtcgtattggcctgcttcataccccatggttttttcctcccttttatttacctaaacaaaattgtgaaaagagctgatcaattaagctttcgtggacggcatcaccgatgatttcgcccagcagctcccagcaccttgtcaaatcaatttgcaccatatcaatcggaacatcctgttcaattccgttcagcgcatcatcaatcgcttgcttggcctgatgcagaatcgagatatgacgggtgttgctgacataggtgagatctccgctttcgatcgctcctgtataaaatagcgactgaatcgcttcctctaaatcttgaatgccttcttctttcagcaatgaggtcgtgacgacaggccggcctttcgccagttccttaacgcgctcagcgtcaatcttagcctcaaggtccgtcttattcataatgacaatgacgtccattccctcaaccgcttcaaacaatttaacatcttcttcagaaagcgcttcgctgtggttaagcacaagcaaaatgagatccgcttccttcagaacctgccgtgaccgttccacaccgattctttcgacgatgtcttctgtctcgcggattccggcggtatcgacaagccgaagcggcacgcctcgcacgttgacatattcctctatcacatcacgcgtcgttcccggaatatcggttacaatcgccttcgtttcatggacaaggctgttaagcagagaggatttcccgacgttcggacggccgatgatcacggtagacagtccctctcgcaaaattttcccctgctcggacgtacggagcagcgcctcgatttctttcttcacgccgcttgccttctccactaaaagctgatgcgtcatttcttcgacgtcatcatattccggataatctatattcacctcaacatgggcaagtgtttctaacaactcatcacgcagacggcggacaagcgcggaaagccgtccttccatctggttcatggcgacattcatggcacggtccgttttggccctgatcagatccatcaccgcttccgcctgtgaaaggtcaatccgtccgtttaaaaatgcgcgcttcgtaaactcaccgggttctgccagtctcgcaccttctcttaaagcaagctggagcacctgattaaccgtcacaatacccccgtgacagttgatttctatgacatcttcccttgtgaatgttctgggcgctcttaaaacagacaccatgacttcctcaataatccgtcccgtcgtactgtccgcgatatgcccgtaatgaatggtatgggattctgccgaactgagcgttttgcctttcggacccttgtacattttgtcggcgatctttacggcttccgggccgctcagccgaacgatcgcaatcgcgccttcacccatcggagttgaaatcgctgcaattgtatccatgctgttcacctctctttatctctgtttccatctatataaaaaattttatttacgccaaaattaaaagataacatagtttggtttgaagtggaagatacgttatccacaaaggcagaaattcatcccttattactttaacttatccacatgtgaataacaattaattttatttcctaaaaccttttttatcaacagcatagaccgaaaaagaaaaaacttaaacgcaaaaaatgcgattctgctcaggaatagagccatttttaccaataaaaaaaccgaagttccgattttacccggacttcggttttctgctatctttatgggaaataacgagatggcggtaccggccttcaccggtagaaaacgttttgatatttggatgctttgacagcgcgtcatggatgatttttctttcacctgacggcatcggttctaaatgcacatcttttttcgttttcgacacttgcttggccagcctgtttgccagctgatccagaatttctcttcttttccgccgataattctcagcgtcgacaacggcttggcgatactggccggagccgcggttcaaaacaagctgcgtcaatgtttccagggcattgagtgtttgtcctcttttgccaataagcagcgccgctttttcacctttaatgtgaaaacagactgttttcttgttttcttccgtaacaatctcagaaggcccggcaatagaatggatgatttcttccaaatacgctttcgcttcctgaacaggatttcttttctcttccagttctacgatcgcattcttttttccgaaaatacccaaaaaccctttatattcttcttgcaccaccgttatttctacttgatctttcgtcagttgaagttcctgaaggcctgattgaactgcttcttcgacattccgtcccgcagcagtcaccttcttcactttttctttcctccggctttctgcgtttccggatcgtgtttaatgtcaggtcctttaataaggaatgtctgagcaatcataaacaggtttccgactacccaatacagagacagcgcactcgggaagttgatcgcaaatacgatgatcatgatcggcataatccataccatcattgccatttgaggattctgagtcggatttcccgccatcatcagcttctgctggacaaaagtggccacaccggcaacgataggaagaatatagtaaggatccttctctcctaaatcaaaccataaaaagctgtgctgtgaaatggcttgcgtacgcataatggcgtggtagaatccgatcaaaatcggcatttgaatcaggatcgggaaacatcctgccagcgggtttaccccgtgctttgaaaacagggccatcgtttcctgctgaagcttctgctgcgttttttgatctttagagctgtatttttctctgagcttctgcatttcaggctgcagcgcctgcatcgcttttgagcttcgaagctgcttgatcatcagcggcagaatcagcagacgaattaaaatcgtaacgatgatgatcgataaaccatagttatcgcccgtcagtttcgctacgtacgtaatgacttctgacaatggatacacaacatatttgtcccagaaatgcggactattcgccgtaatcggctctttcacactcgagcatccggccagcagcacgagcataccgaccatactcagtagtaaccatattctccttttcaagaacgtttcctcctataccaatctttataaaccttgtatgtattttagcatctttcagtttcaaatggcgttcatttttcgccaaataaaaggaagcgcttttaaaaacgtgaagaaaacaaaatatgagctattttgacgaagatttcttatataatgaggtttttctgaataagtgctgcagactctttttcgtttcttcaaaactgaggtcgccggcgggttttcttgcgataataataaaatctttcggcttgagcagctctttttcctcctgaacagcctgtctgattaaccgcttcacccgattgcgcacgacggcattgccgatttttttactgacagaaagccctacccggagctcttcctgtttcggctgatcaagcgtatacagcacgaactggcggtttgccatagacgttccgcgtttaaacactttttgaaaatcttcatttttctttaaccgatttcgcttcttcactttaattcactccgatattcactcgcagaaacttttatttctatctaaaaaaaacgggccgccggaatactgaagaaatttctccagtaccgggcgacgcatgacatctcttttctcttaatgtgaaaaaagaccactgacattattcagtggcctaagctgataatacttttctgcctttgcggcgacggcgtgctaatactagacgaccgttttttgaactcatacggcttctgaagccatgaactttactgcgtttacggttattcggttggaatgttcttttcatttatgacacctccctcgaggaatagctgttaaagacagtcttacttattatatttgtgctgcctattcattgtcaacttcagcagtgcttttatttcttacaaccataataggataacataccttaaccagattagaaaccttatttttcatattcctttttttaacgcacaaaaaaagccgcgctcccccgaaaaaacgtcatgtggataatttttcggtctttttttaatatccacaatcgttatcgacaacattttcacattgctaacccctgtggacaaagatttttcaacaagttgtcaggtttgtggataagattacgagaaccattgcaagtcctcgcttaatttgatattatatttgtgttttaactcttaattacttatccagtccattctctttatccacaaattgtggataagttgtggattgttttcacacagcttgtgtagattgttgtccacaacttgtggaatttgtcgaaaagctatttttctactatactatatgttttcaacatttcgtgtgtacgaatggtcagagccatatgctctttttttgtgttctataacaggggaagggcgctgatttttaaagaaaaggagggctgtgccggataatggagaatatattggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattaagcgtcaaatttgtcattcctcaaaatcaggacgaagaagactttttgccgaaaccgcaagtgaaaaaagcggcaaaagaggaaccgtctgattttccccaaagcatgcttaacccgaaatatacattcgacacattcgtcatcggatcgggaaaccgattcgcccatgcagcatcactggctgtggcggaagcacccgctaaagcatacaaccctttatttatatacgggggagtcggcttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacgcttcatgaagaaagcaaacaaatcgtgatttccagtgacagaccgccgaaagagatcccgacccttgaagaccgcctgcgttcgcggttcgaatggggattgattacagatatcacaccgccggatctggaaacgcggattgccattctgagaaagaaagcgaaggcggagggccttgatattccgaacgaggtcatgctttacatcgcgaatcagattgacagcaacatccgcgaactggaaggggcattaatccgggttgtcgcctattcatccttaatcaataaagacattaacgcagacctggcagcagaagcattgaaagatattattccgtcttctaagccgaaggtcattacgataaaagagattcagcggattgtcggacagcagttcaacattaagcttgaagatttcaaagcgaaaaagcgtacgaaatccgtggctttcccaagacaaattgcaatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataatagtgccctcggatgaatcggggaaagtgtgaataactttttcatagccatgcacagtctgtccacatgtggataggctgtgtttcctgtctttttcacaacttatccacaaatccacaggccctactattactactgctatttttaaaatatattaattatattatccgttaggaggataaacatgaaatttacgattcaaaaagatcggttagtcgaaagtgtacaagacgttctaaaagccgtttcatccagaaccacaattcccattctcaccggtattaagatcgtcgcctcagatgaaggagtatctttcacaggaagtgactctgatatttcaattgagtcattcattccgaaagaagatgatgataaagaaatcgtgacgatcgatcagccgggaagtatcgtgctgcaagcgcgtttcttcagcgaaatcgttaaaaaactgccgatggcgactgttgaaatcgaagttcaaaatcaatatttaacgattatccgttccggaaaagccgaatttaatttaaacggccttgatgcagatgaatatccgcatctaccgcaaatcgaagagcatcacgccattcagattccgacggatcttttgaaaaacctgatccgccaaaccgtgttcgctgtgtccgcctcagaaacacgccctatcttgacaggtgtaaactggaaagttgaaaacggtgaattattatgcactgccacggatagccaccgactcgctttaagaaaggcgaagcttgatattccggaagacagctcttataacgtcgtcattcccgggaaaagcttaaccgagctgagtaaaattcttgatgacaaccaagagctggtggatatcgtcattacagaaacccaagttctgttcaaagcgaaaaacgtattgttcttctcaagattgcttgacggaaactatccggacacgaccagcttaattccgcaggaaagcaaaacggaaatcgtcgtgaacacgaaggaatttttacaggcgatagaccgtgcttctttattggcgagagaaggccgcaacaacgttgtaaagctttctgccaaaccggcggattcgcttgagatttcatcaaattctccggaaatcgggaaagtggtcgaagctgtgctggctgaccagattgacggcgaggaattaaatatttcattcagtccaaaatatatgatggacgcactgaaagtacttgaaggagcggacatccgcatcagctttacgggagcgatgagaccgtttcttatccgtacgccgaatgatgagaccatcgttcagctcatccttccggtcagaacgtattaatcaaacagaatgtgctgccggcttagttcggcagcttttctattcatcagccgctccctcaagttttccctttccttatttcaggattttttagtacaattagatattagtgatatttgaaagaggtcgatattatggcaaatccgatttcgattgatacagaaatgattacgcttggccagtttttaaaattagccgatgtgattcagtccggcggcatggcgaagtggtttctgagcgagcatgaggtgactgtcaacaatgaacctgacaatcgccgcggcagaaagctttacgttggagacgtggtcgcgattgaaggatttggttcatttcaagtcgtcaattaaagcgggtgacagcggttgtatatccaaaatttagaattaacatcctaccgtaattatgagcgcgctgagcttcaattcgaaaacaaggtgaatgtgatcatcggggaaaatgcccaaggcaaaaccaatctgatggaagccatctatgtcctttcgatggcaaaatcacaccgcacctcaaatgacaaagaacttatacggtgggacgaagactatgctaaaatagaaggaagagtgatgaagcgcaacggggacatcccgatgcagcttgtcatctccaaaaaaggtaaaaagggcaaggtcaatcatatagagcagcaaaaactcagtcagtatgtcggagcgctgaacaccattatgtttgcccctgaggatttaaatctcgtcaaaggaagccctcaggtgaggagaagatttctcgatatggagatcgggcaggtttctgccgtttatctgtatgatttatctctttatcaaaaaatcctttcacagcggaatcattttctgaaacagctgcaaagccggaaacagactgaccggaccatgcttgacgttctcactgatcagctgattgaagcagccgcaaaagttgtcgccaaacgtctgcagtttacggcgcagcttgaaaaatgggcgcagccgatccattccggcatttcccggggacttgaagaactgacgcttaagtatcacacggcgcttgatgtatcagatcctaaagatttgtcgaaaataggtaacagctaccaggagtctttttcgaaattaaaagaaaaagaaatagaacgaggcgtcacattattcggaccgcatcgggatgatgtccttttttatgtgaacggacgcgatgtgcagacttacggttcgcagggacagcagcgtacgacggctttgtctctgaagctggctgaaatagatttgattcatgaagaaatcggagaataccccattttacttttggatgatgtactaagcgagctggatgattaccggcagtcccatttgcttcatacgatccaaggccgtgtgcagacatttgtcaccacgacgagcgtggatggcattgaccacgataccttacatcaagcaggaatgttccgtgtggaaaacggtacgttagtgaagtgaagaaatgaggtgagcgattgtatattcatttaggtgacgactttgtcgtttcaacccgcgatattgtcggcatttttgactgcaaggtcaatgtatcgccgatcgttgaagaatttctggacagacagaaagaaaaagtagtgccgtccgtaaacggcacgccaaagtctatcgtagtcacgactgagaatatatattactctcccttatcttccggcacactgaagaaacgtgcgcaatttatgttagaaatagattcttagcggatctttacaatgaatatattatcgtttaagaaaagtgtaggtgaatgtgcatggctatggaacagcagcaaaatagttatgatgagaatcagatacaggtattagaaggtttggaagctgttcgaaagagaccggggatgtacatcggatcaactaacagcaaaggccttcaccatttggtgtgggaaatcgtcgacaacagtattgacgaagccctggccggttattgtacagatattaacatcgagattgaaaaagataacagcattaccgttaaggacaacgggcgcggaattccggtcggtatccaggagaagatgggccgccctgcggttgaagtcatcatgaccgttctccacgccggcggtaaatttgacggaagcggatataaagtatccggcggtcttcacggtgtaggggcgtccgtcgtaaacgccttgtcgaccactcttgacgttacggttcatcgtgacgggaaaatccactatcaggcgtacgagcgcggtgtacctgtggctgatcttgaagtgatcggcgaaactgataagaccggaacgattacgcacttcgttccggacccggaaattttcaaagaaacaactgtatatgactatgatctgctttcaaaccgtgtccgggaattggccttcctgacaaaaggcgtaaacatcacgattgaagacaaacgtgaaggacaagaacggaaaaacgagtaccactacaaaggcggaatcaaaagctatgttgagtacttaaaccgttccaaagaagtcgttcatgaagagccgatttatatcgaaggcgagaaagacggcataacggttgaagttgcattgcaatacaacgacagctatacaagcaatatttattctttcacaaataatatcaacacatacgaaggcggcacgcacgaggccggatttaaaaccggtctgacccgtgtcataaacgactatgcaagaagaaaggggattttcaaagaaaatgatccgaatttaagcggggatgatgtgagagaagggctgactgccattatttcaattaagcaccctgatccgcaattcgaagggcagacgaaaacgaagctcggcaactccgaagcgagaacgatcactgatacgctgttttcttctgcgctggaaacattccttcttgaaaatccggactcagcccgcaaaatcgttgaaaaaggtttaatggccgcaagagcgcggatggcggcgaaaaaagcgcgggaattgacccggcgcaaaagtgcgcttgagatttccaatctgccgggcaaactggcggactgttcttctaaagatccgagcatttccgagctgtatatcgtagagggtgactctgcgggcggatcagcgaaacagggacgggaccgtcatttccaagccattctgccgctgcgcggtaagattctgaacgttgagaaagccagacttgataagattctctcaaacaatgaggtcagatcaatgatcacggccctcggaacagggatcggagaagattttaatcttgaaaaagcgcgttatcataaagtggtcatcatgacggatgccgatgttgacggcgcccatatcagaacgcttttattaacgttcttctacagatacatgcgggaaatcatcgaaaacggctatgtctacattgcccagccgccgctttataaagtgcagcagggaaaacgggtggaatacgcttataacgataagcagcttgatgagctgttaaaagagcttccgcaatcacctaagcccggcctccagcgttataaaggtcttggagaaatgaacgcgactcagctttgggaaacgacaatggaccctgcgaccagaacgcttctgcaagtcaatcttgaagatgcaatggacgctgacgagacttttgaaatgctgatgggtgacaaagtagaaccgcggagaaacttcatagaagcaaacgccagatacgtgaaaaatcttgatatttaaccaagaaagccttattttcgttaagaaataaggcttttttctcaaagcggcttctaaagcctctgaaatccgcaaaacccgtatattctactaaattaatgtgtataaacacaagtttattgatataatggagaatagtgaaatcgtattgaagatcataatggacaatctactcccacattatttcatgtgatacttcagggaggtttttttaatgagtgaacaaaacacaccacaagtacgtgaagtcaatatcagtcaggaaatgcggacatccttcctggactatgcaatgagcgttatcgtatcccgggcgcttccggatgtgcgtgacggtctgaagccggttcacagacggattttgtacgcaatgaatgatttaggcatgaccagtgacaaaccatataaaaaatctgcccgtatcgtcggtgaagttatcggtaagtaccacccgcacggtgactcagcggtttacgaatcaatggtcagaatggcgcaggattttaactaccgctacatgcttgttgacggacacggcaacttcggttcggttgacggcgactcagcggccgcgatgcgttacacagaagcgagaatgtcaaaaatcgcaatggaaattctgcgtgacattacgaaagacacgattgactatcaagataactatgacggttcagaaagagagcctgccgtcatgccttcgagatttccgaatctgctcgtaaacggggctgccggtattgcggtcggaatggcgacaaacattcccccgcatcagcttggagaagtcattgaaggcgtgcttgccgtaagtgagaatcctgagattacaaaccaggagctgatggagtacatcccgggcccggattttccgactgcaggtcagattttgggccggagcggcatccgcaaggcgtatgaatccggacggggatcaatcacaatccgggctaaggctgaaatcgaagagacttcatcgggaaaagaaagaattattgtcacggaacttccttatcaggtgaacaaagcgagattaattgaaaaaatcgcggatcttgtccgggacaaaaaaatcgaaggaattaccgatctgcgagacgaatccgaccgtaacggaatgagaatcgtcattgagatccgccgtgacgccaatgctcacgtcattttgaataacctgtacaaacaaacggccctgcagacgtctttcgggatcaacctgctggcgctcgttgacggacagccgaaggtactaagcctgaaacaatgtctggagcattatcttgatcaccaaaaggttgtgatccggcgcagaacggcttacgaactccgcaaagcggaagcgagagctcacattttggaaggtttaagaattgctctcgatcatttagatgccgttatttctcttatccgcaattcccagacggctgaaattgcgagaacgggtttgatcgaacaattctcactgactgaaaaacaagcgcaagccattctggatatgcgtcttcagcgattaaccggtctggagcgcgaaaagattgaagaggaatatcaatcacttgttgcgcttatcgctgagctgaaagatattttagccaatgaagaaagagttcttgagatcatccgtgaagaacttaatgaaatcaaagagcgtttcaatgatgagagacgcactgaaattgtgacgtccggtcttgaaacaattgaagatgaagatcttatcgagagagaaaatatcgtcatcacactgacccataacggctatgttaaacgtctcccggcgtccacataccgcagccaaaaacggggcggaaaaggcgtacagggaatgggaacgaatgaagatgactttgtggaacacttaatttccacatcaacgcacgatacgatcctgttcttctctaataaagggaaggtataccgttctaaaggatatgaaatccctgaatacggccgaacggcaaaaggcattccgattattaaccttctggaagttgaaaaaggcgaatggattaatgccattattccggtcagcacgtttgatgaggagcaatacctcttctttacgaccaaacaaggggtgtcgaaacgtacggcactgtcccagtttgcgaatatacggaataacgggttgatcgccctaggtctccgggaagacgatgaactgatggccgtccgcctgactgacggcaagaaacaaatcatcatcggaacgaagaacggtttactgatccgtttccctgaagaagatgtaagacaaatgggacgcacagctgcgggtgttaaaggcatcacgctgacagacgaagatgtcgttgtaggtatggagattcttgaagaagactctcatgtcctcatagtgacagaaaacggctacggcaaacgcacaccggcttcagaatacagagttcaaagccggggcggaaaaggtcttaaaacatgtaaaatcactgacagcaacggtccgttagtaaccgtgaaagcaacaaaaggcgaagaggacttaatgattattacggcaagcggcgtgttaatcagaatggatattaatgatatctccactacgggacgcgtaactcaaggcgtccgtctgatccgcatgtctgatcaagagcatgtagccactgtggcgcttgtcgaaaagaatgaagaagagccggaagaaacggaagaagtataaacaaaaaagcgcagctgcaacaggctgcgcttttactatataaagaaatgaaaaaaagctttgacacatagtgatgatgctgatataattctttttgttgtctttttaatagaaaggcaagcctagcgaaaatattttttaaaaaagtattgacctagcaaactgaaaatgttatgattaagaggtcgcttcgagagaagtggaaaagttctttgaaaactaaacaagacaaaacgtacctgttaattcaaagttttaaataaatcgcacagcgatgtgcgtagtcagtcaaactaaggtctgcatgatgcagatcacacagacgttactgcaggatgcagtgaacttagtctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggaactttaattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctattattacggtaaaggcagctcatcatgagctgccttttttgtttataagtattgcttcaggaatttagaaacgtaatacggaaatttgcgttccgtgacctctaagaaccgtcggatcatcacataatcatcactgacatgctgtgtcagcagttcataccaccactccgtttcatatcttgcaatcatcccgatattgtagaggaccaaataatgaataatcatttccggaagatgcaggaagtgatcacgctgagagggaatgtaatattgatttttctccaagtgaaacaataaatttggagaagaccaaggttctctttctatcgggtcagcctcaaaaaccaagtggttatggtctttcctcagaaaagaccatttcaaatgatggctgatatattcagcaaagcgggaatcagacatattgtaatgaatcaccgcatgctcaggcactgaaataaggtcatctttcagctctacttgggtcagccaattctttttctcttggaagtaaaagacagtatgcaattcaggtatggctgtcagcaatttcttcattgtgtaccgttcttcctcaagaccagctattccgaataagtgcttcattacatgaatacataagccattgcgctgcaccttcacttcatcatccctaaaggagtaattttgctttttgcgtttccgggcagtcacgccatgtgcgagtactgaagcgtggcttggatagcttggatctgtggtcagaaggcaggctttcagcaattgtgacatcccgtaaaacaacagaataggcttaatttctaaaggtgaaagagatgcctgcttatagaaggactcggcgtgtttgataaagaatatgaagcgctcactgttcttaaacgcatatcgttttggttcttccatgccgctttctgtatagactttgcttagaaatttttgggaagattctacggaataaaataatgataactctttccactcatgatctctcatatgtatttttaaaccctttcctttatctaaatatttcaactctttttcgcttccttgacatgctgttttctagttgataatctacatataatattttgccgaaaagagggggatttactaatgtgggaaagtaaattttcaaaagaaggcttaacgttcgatgatgtactgctcgtaccggctcaatcagacgtacttccgcgtgatgtggatttatctgttgaactgacaaaaacgttaaagcttaatattcctgtcatcagtgcgggaatggatacagtaacagaatcagctatggcgattgcgatggccagacagggcggcttaggcattatccataaaaacatgtccatcgaacagcaggctgaacatgttgacaaagtcaaacgttctgaacggggcgttattacaaatcccttctttttaacacctgatcatcaagtattcgatgcggagcatttgatggggaaatacagaatttccggtgttccgatcgtagataataaagacgatcaaaagcttgtcggtatcattacaaaccgtgatcttcgctttatctctgattattcaatgaaaatcagtgatgtcatgacaaaagaagagctggttacggctcctgtgggaaccacattagacgaagcagaaaaaatcttacagaaacataaaattgaaaaacttccattagtggatgaccaaaacaaattaaaaggtcttatcacgatcaaagatattgaaaaggttatcgaattcccgaattcatctaaagatgaacacggacgccttattgtcggcgctgcggtaggcgtgacaggcgatacaatgacacgcgtcagcaagcttgttgaagcgaatgtcgacgttatcgtggttgatacggctcacggacattccagaggcgtactgaacacagttgcgaaaatccgtgaaacatatcctgaactgaacattatcgcaggaaatgttgcaacggctgaagcgacaaaagctctgattgaagccggagcaaatattgtcaaagtgggaatcgggcctggttctatctgtacgacacgcgtcgttgcaggtgtaggcgtaccgcagatcactgccatttatgattgtgccactgaagcgagaaaacacggcgcgacaattatcgcagacggcggtattaaattctccggagatattacgaaagcgttggcttcaggcggacatgccgtaatgctcggaagcctgcttgccggtacttcagaaagcccgggagagactgaaatctatcagggcagaagatttaaagtatatcgcggtatgggttctgtcgctgccatggaaaaaggcagtaaagaccgatatttccaagaagaaaataagaaattcgtccctgaaggtatcgaaggacggactccgtacaaaggtcctgtagaagaaacagtgtatcagcttgtcggcggtcttcgttcaggtatgggatattgcggttcaaaagacttgcgcgctctaagagaagaggctcaattcatccgtatgacaggtgccggtcttcgtgaaagtcatccgcatgatgtccaaattacgaaagaatcaccaaactacacaatctcataattgttacaaataaaaaacatttgacagggtcgctgactctgtctattttttttatatcgagtgtgataaaatttatactgttgtgttttgaatttgaatatgtccttaacggcttaattatagatttaaaatgaatgacggaggtcgtaagattgaacatcacgaaatggaaacagctgttggtgtcattagtggtactggcactggccgcaacttgctttgttccgatgtctaaagcggaggcagccggcaatgacccgattgatgtcaacgcatcagctgcgataatgattgaggcttcatcgggaaaaattttatacagtaaaaatgcagacaaaagactgccgattgccagcatgacaaaaatgatgactgaatatctgcttctggaagccattaaagaaggaaaagtgaaatgggaccaaacgtatactccagatgattatgtctatgaaatttctcaagacaacagtttatcaaacgtcccccttcgaaaagacggcaaatacacggttaaagaactgtatcaggccatggcgatttactctgctaacggagccgcgattgcagttgccgaaattcttgccggaactgaaacgaaatttgtcgctgaaatgaatgcgaaagccaaagaattaggcatgacaaactatgattttaaaaatgccacagggcttgtgaatgaagaccttcacggcaagcagccgcaaggagaaggcgttaaagaagagagtgaagtttctgctaaagacatggcgcttcttgcagaccgcctgatcactgattatccggaagttctcaaaacaacaagcatcgctaaaacgaaattcagagccggcactgatgatgaaatggacatgccgaactggaacttcatgttaaaaggtcttgtttctgaataccctggcgttgacggcttaaaaacgggttctactgattctgcgggatcttgttttacaagcacagcacagcggaacggaatgcgggtcatcaccgttgtattaaacgcaaaaggcaacctgcataccggacgttttgatgaaacgaaaaaaatgctcgattacgcatttaacagcaatttctcaatgaaagatctttaccctgaaggctctcaagtaaaagggcacaaaacggttgacgttgaaaaagggaaagacaagcaagttgatattgttactgacaaggcgctttctattcctgtgaaaagcggggatgaaaagaactataaagccgaagtgaatatagataaaaaagaaatcacggctcctgtgaaaaagggaacgaaagtcggaacgctgacagttacatacaaaggcagtgacaaagactatggattcctcaaatccaaagagttcagcgtgaatcttgtaacgaaaaatgatgtagataaagcaaactggtttgttcagatgatgcgcggcatcggcggattcttctccggtatctggaacagcgccgttgacacggtaacaggctggttttaagaaataagaaagagctctgatgaaagttagggctcttttgcttaatatactgaaaaaaccaaattattagtaaaaaaatgatatctatcttatttatctcgctgtaaaataagaatacccatatgaaatattgtatttctgggatacaataagagatagacattatctaactatacattgactagggggaccaaataatggctcaaacaggtactgatcgtgtaaaacgcggcatggcggaaatgcaaaaaggcggcgtcatcatggacgttgtaaatgctgaacaagcgaagattgcggaagaggcgggagctgttgccgtaatggcgttagaacgcgttccggctgatattcgcgctgccggcggtgttgcccgcatggctgatccgacaatcgttgaagaagtaatgaatgctgtatccattcccgtaatggcaaaagcgcgtatcggacatatcgttgaagcgcgtgtccttgaagcaatgggggtagattacatcgatgaaagtgaagttctgactccggctgacgaagaatttcatttaaataaaaatgaatatacagtcccgttcgtatgcggctgccgtgatctcggcgaagcaactcgtcgtatcgccgaaggagcttccatgcttcgtacaaaaggcgaaccgggaacaggaaacattgtggaagctgtccgccatatgagaaaagtaaacgcgcaagtgcgcaaagttgttgcgatgagcgatgatgagctgatgactgaagctaaaaacctcggcgctccttatgaactgcttcttcaaatcaaacgtgacggcaaactgcctgtagtgaactttgctgccggcggagtagcgacgcctgctgacgcggcattgatgatgcagcttggcgctgacggcgtatttgtcggttcaggtattttcaaatcagacaaccctgctaaattcgccaaagcaattgttgaagcaacgactcattacacagactacaaactgatcgctgagctttctaaagaattaggcacagcaatgaaaggaatcgaaatctcaaatctattgccggaacagcgtatgcaagaacgcggctggtaaaaccataggagagctggaagcatgttaacaattggtgtacttggacttcaaggagcagtaagagaacatattcgttcaattgaagcatgtggttcaaaaggtgtcgtcattaagcgtcctgaacagctgaatgacatcgacggcttaatcctgccgggaggggaaagcacgacaatgcggcgtttaatggatacgtatcattttatggagccgcttcgcgagtttgccgcccaaggcaagccgatgttcggcacatgcgccggtctgattatcttagccaaagagatagcgggaacggataatgctcatttagggctgttgaacgttgttgtcgagcgtaattcctttggccgtcaggtcgacagctttgaagctgatctgacgattaaaggccttgatgagccgtttacgggtgtatttattcgcgcaccgcatattttagaagccggagaagatgttgaagtgctttgtgagcataacggacgcatcgtggctgcaaagcagggaaatttcctcggctgctcgttccatcctgaactgacggatgatcaccgggtgacagagctgtttgtgaagatggcggaaaagcataagcaggaaacagctgtataaaacagttgaaaaccgctgatacttatagtacattataatcacaaataaagatcgaaaagcgttgacaggaagcagtagggagcccctctttcaaagagagccgatgggtggtgcgaatcggtgaaagatgctgtccgaatccgtccttgagcgaaatgctgaaaacaagtaggcatttacgggaaaaccgttatgtgttaaagcgggaagcaagtgtgagcttgttttcaatcagggtggcaacgcgagagctctcgtcccttttaggggatgagggctcttttttattttcgataaaaacagataggagttgttaggcatgattgatacgaaggtgctgagagccaattttcaagaggtaaaagcgaagctcattccaaaaggcgaagacttatctgactttgacaagtttgaagagctggatgaaaagagaagagagcttatcggtaaagtagaagaactgaagggaaaacgcaatgaagtgtctcagcaggtcgccgttttgaaacgggagaaaaaagacgctgatcatattattaaagagatgcgtgaagtaggcgaagaaattaagaagcttgatgaagagcttcgtactgtcgaaacgacgctcgaaaccatccttctgtctattccgaacatcccgcacgattcagtgcccgtcggagaaacggaagatgataacattgaaattcgcaagtggggagaggcgccggcattttcatatgagccgaaaccgcattgggatatcgcagaccgcttaaacattcttgatttcgaacgcgcttcaaaagtaacaggcagccggtttgtgttttataaaggattaggcgcccgcctcgaacgcgcgctctacaactttatgctggatcttcacgtggatgaatatgattacacggaagtcattcctccttatatggtaaaccgtacgagcatgacaggtacgggacagcttcctaaatttgaagaggatgcttttaaaatcagagaagaggattatttcttaattccgacggcggaagtgccgattacaaatatgcaccgcgatgaaatcttatccggtgagaacctgccgatcaattatgccgcgttcagcgcctgcttccgttcagaagcgggatccgccggccgtgatacacgcggtttgatccgtcagcatcagttcaacaaggttgagcttgtaaagttcgtgaagccggaagattcttatgaggagcttgaaaaactgacaaatcaagctgagcgggtgcttcagctgcttgaactgccgtatcgcgtcatgagcatgtgtaccggtgatctcggctttacagctgcgaaaaagtacgatattgaggtttggattccaagccaagacacatatcgtgaaatttcttcttgcagcaactttgaagccttccaggcaaggcgtgcgaacattcgtttcagacgcgaagcgaaaggcaagccggagcatgtgcatacattaaacggttcaggtcttgcagtcggccgaacagtagctgccatcttggaaaactaccagcaggaagacggaagtgtcatcattcctaaagtgcttcgtccttatatgggaaataaagaagtcatcaaaccataaaaaggtgcgccctagaggcgcgccttttttgctgcccggtatagagcggcggcattccgagctgtgctttcaaggttaaaacggccggatgctaaggcgtcttcaagacttacagggccgggcacgatagaaaatacagctgttattcctgcgctgtaaacatgctcgaaatttttgcctaaggagcccgccaatgcgataacgggaatttcttgagcggctgcgcgtgaggcgatcccggcgggggttttaccgaatatcgtttgtccgtcaatctggccctctccggtaatgacaaggtcagcatctcttatctgatctgagaaggacagtgtatctaatacaacgtcaatcccgctttgaagttctgcctgtaagaaagcgatcagtccagcgcccagcccacctgcggcgcccgcgccttttacggtatccgcttcgatatcgtgctgacgtctcaatacatcagcgaaatggcgtaaattgcgatccaatacaactttagtcttctcggacgcccctttttgcgggccgaagacatatgacgcgccgttttcaccggtcaggggattttcgacatcacatgcggcacgaaaacggatatgtttcaaatcaggggagagcccgcttatatcaatagaagctagggtgtgcagagcgcctccgccgtcaggtatctcctgaccttcctcatttaagaaacgcacaccgagcgcgctcgccattcctgttccgccgtcattggttgcactcccgccaagcccgatgatgatctcactcgccccgcgggaggctgcatctgctattagttcacccgttcctcttgtcgttgtgttcaacggatctctgaggtggcggggaacgagatggagacccgatgcttccgccatttcaatgactgccgtgcgtccgtctcccagaagtccatatgcggcgtttaccggtgttcccagcggaccggtcacagtttttttgatgatgcttccgccagtggcatccgtcaaagcctgaacggttccttctccgccatcagccgcgggtatcttggtatattccgcgtcagggaagaccgctttgaatcctttttctatgctgtcagctgcttcttttgatgtcatgctttctttgaaagaatcgggtgcaatgatgattttcattatgttctccacctttatgagcaggttatctgtttgaatctattcttgatttttattgtgttttcctgcccgtatggcatactgaggttgaattggacgcaagacttttgtatgatagtaaagctgacggaaaagctgtttaagaaatgaaataaaaaatatgaaaaagcgcttgactgaaatctgggtcatgtggtatattattaaatgtcgatacggaggaatacccaagtctggctgaagggatcggtcttgaaaaccgacaggggtgtcaaagcccgcgggggttcgaatccctcttcctccgccatattgattttaaacctaatgaaactcgagcatatattggagattgttttgtccgctgcatgtaatgcagcggattttttatatgcaaaaaaagcgattttctctgttcggggaaaatcgctttgctatttttatttgtttctgttttcgttgatcacgtgactgattttttcgatcaaaggttccagtgactgttcatcagcttcaaggtcataatcttcaatgcgtactttcagcacagggcaggcgttaaaaccgctgatccagtcttcgtaccgtgtatacatctcttcccaataagagcggtttgtctgcagctccatctcgcggccccgcttttcaatccggcttataatgtattcaaggtcgccttctaagtagatcaaaacatcaggatgcgggaaatacggcgtcatgaccatcgcctcaaataggcttgtgtatgttgtgtaatctgtcagcgacatggttcctttatccgcatgcatttttgcgaatatgcctgtatcttcataaatcgaacggtcctgcacgaatccgccgcctgattcaaacatgtttttctgctctttgaaccgctcagccagaaaataaatttgcaaatggaagctccagcgttcaaaatcgtgataaaacttctctaaataagggttttcatccacttcctcaagtgaggtatgaaacccgagccgttttgctaaagctttggtcaaagtcgattttccgactcctaccgttcctgctactgttataatggcattgtttggaatatgaatgtctttcatttaataagctcctttacctgacgggcaattctttcatagtctgtcttattcaaaacaaagtcttcagtatcaccgtcaatggtcagtacagatatatccggatcttcttcctgaagctgtctgatggctgtgtcgtaatctgcaatgagatgttccagatattgatgttcgatatttttttcaaacgggcgcccgcgtttttcaatgcgttgaagcaatgtcggcaggcttgcctttatgtatacaatgatattcggcttcggcaggtcgtgagtgagcagatgatagatctgcttatacttctcaagcttttggccgtgcaatgtacgctctgcgaaaataacatttttataaatatgataatcggacaaaacgggctgtccttgttttaaataatctcgatcggtgtcttcaagctgtttatacctgtgacatagaaaaaacatttcaagctggaaactccactcctcgatattgtcataaaacttatcgagataagggttgtcttccacaatctcattaatcataggaaaaccgagctcttcagaaagcattgtagcgagtgtcgtttttcctgccccgataggaccttctaccgcgataaaaggggctctgttcattgaaaatcctccttaattctgcaaacatccgtcagctgccggcctttatattgtatcacactcacagaaaagcccatgaaaaaagacgcttccaattaacgaaacgtctcttttacaatatgaaattgatcgccgagcaaaagccagttttgcgggaaagaaaggccgagtttccaatagctgattcctcttaaatgaagttctttaattaaattgaatttcgcttgaatggatcgtgcgtcttcaaaccatacttcatgccgtttctgatttgcatccgtgtatcggaagaagggagcctgggcggtttcgtcatattgaatgtcgactttatagcgtgcggccagagcgattgcctgctgaggactgacggctttcgctgtcgttccctgtttaaaaggcagtgtccaatcatagccgtacatattctgacccatgacgatttttgaagaaggcatttccgtcagcgcgtactcaatgacatttcttacagggccgataggtgatacggcctgagccgggcctccgctgtacccccactcatatgtcataatcacgacaaaatcgacgatttctccatgtgccctatagtcatgagcttcgtaccatttgccggcctgagtcgcgctcgttttcggagcaagcgccgttgaaatcttccagccttcccgatgaaaaatcgttctcgcttcacgtaaaaatcgattgtaagcttccctgtcctgtggacgtaaatattcgaaatcaaagtgaatatcgcgaaagccgtactttttagccgtggagacgatttcctgaaagagttttgttttcactgtattgtcattcaagatgagccgcccgagttcatcgctgaatgcgtcattttcaaggttggtgatgatcatcatcagagtggtgttgtgcctgtcactgatgctttttaaattggtcagaggcggttcctttaaagtcccgttccgctgcacttgaaaactgaatgcgccgaggtatgttaaataaggagaggcctcccttgccgcctgctgcagattagcgcttacgctcgttccccgcggttctatatatgcgtttgattcgatatcgggcttattcgcctgctgcggaatgtaaaggcgggttccgactctcaatgtggtgccgggctgaattccgttcaccctcgcaagctccgcggccgatatatggaaacggccggcgattgacgcgagagtatcaccttgttttacttcgtaatattgaccctcaatcgggatgacaagggtttgtccgacaaccaatgtattgggattaggcagtttatttgcttccgcaatgacatttgcggctgtccggtagcgcgccgcaatagcggaaagcgtgtcgccccgtttcactatatagatctgaatgaaaaacgcctcctttcatatccgctatcaaatatatgaaaaaaggaggctgatcatgtttatttttcggcggtaatttgtttttccgtggttatttctgcgaagagaacattctccatcatggtcaaagcgaaatcattgtcttcgtcgttattggaagcggtgcagtctttcggaatggcaatgctgtattctctcatataggcgtcgttggccgtgaacagcacacaaatgtttccggcaatccccgtgatgattaatcggttcacttgtaattcggtcagaagggtgtgaagcgccgtttcgtaaaaagcggaatgcttcggtttaatgagaaaataatcatccggctgaggcgaaatatcttttataatggaggcgcttctgtcgttgctgcattcctccctgatggcatcaatatcagccttccagagcccgtaatgatcattaatataaataatcggccagttgctttgttttgcatgcttctttaatgataaaatacgggggacaatttgtttggttttttcagcaagacgttcgcccatatcaaattgaaaattgttgatcatatcgacaatcagaagggctgtgttgttaggttcagacaataccggcaactcctttctgctggggtattcctattttaacctttatgagacatgaaaaaacttaagaagagagctcgaacctatgaatgatgaatattatatgagagaagccataaaagaagcgaagaaagccgaagcgaaaggtgaagtgccgatcggagcagttcttgttctgcacgatgagatcgtggcgcgggcgcataatctgcgggagactgaacagaggtcgcttgcccacgccgaaatgctggcgatagacgaagcgtgccgtaagctggggacatggagacttgaggatgccgttctttatgtcactttggagccgtgtccgatgtgcgcgggagccgtcgtgctttcgagagtcgataaggtcgtattcggcgcatttgatcccaaggggggctgtacaggaacgctgatgaacctcttgcaggaagagcggttcaaccaccaagcggaagtggtgagcggcgtgctcggagaagagtgcggagaaatgctcagcgcttttttcagaaagctgcgccggcaaaagaaagacatgaggaaaaagttgtctgagtagtacggttgcattttctgcctgaagcagatatacttatgtgtgcatcatgaatgatgcgcatatcaaaatttgatatttattttgccgtgctaagcggggaggtagcggtgccctgtacccgcaatccgctctagcggggccgaatcccttctcgaggttcgtttactgtaaggtctgccttaagtaagtggcgttgacgtctgggtcctgcgcaatgggaattcatgaaccatgtcaggtccggaaggaagcagcattaagtgaaacctctcatgtgccgcagggttgcctgggctgagctaactgcttaagtaacgcttagggtagcgaatcgacagaaggtgcacggtaaatcaatcatcaaatttcagactcacctgtttatggcaggtgagttttttcgtatatgaaaaacgggttttggcgttaaaagcacgttcatgtataataaacatgatgaataacagaggagggcgcatcctgtgggttaccaagctttatatcgagtatttaggcctcagcagtttgaagatgtggtcggacaggaacacattacgaaaacgctgcaaaatgcccttttgcaaaagaaattttctcatgcatatctgttttctggaccgcggggaacgggaaaaaccagtgcagctaaaatatttgcgaaagcagtcaactgtgagcacgcccctgtagaagaaccgtgcaatgagtgcgcggcgtgcaaggggatcacaaatggctctatatcagatgtgattgaaatagatgcggcgtcgaataacggcgtagacgaaatccgcgacatccgtgacaaagtaaaattcgccccgtcggccgttacttacaaggtatatattatagatgaggtgcatatgctctctatcggcgcattcaatgcgcttctgaaaacgctggaagaaccgccggcacattgcattttcatattagctacgactgagcctcataagattcctttaaccattatctccagatgtcagcgttttgacttcaaacggattacatccaaagcaattgtcggacgaatgaagacaatcgtcgatgcagagcagctgaaggtggaagaaggagcccttgatatcatagcgagtgctgcggacggaggaatgagggacgcgctgagcctgctcgatcaagctgtatcattcagcggcgaggagctgtcggtggatgacgctttgctcattaccggagccgtttctcagcactatattggaaaactggcatctgctctacaccgcaaacaggtttccgaggcattggaaacactgaatgaattgctccagcaggggaaagatgcggccaaactgattgaagatatgattttctatttcagggatatgctcttgtaccaggccgctcccggtttagaaggagtcctggagaaggtgaaggtcgatgaaacgtttcggaatctgagcggtgacataccggcccccgctttatatgagatgattgatatcctgaataaaagccatcaggaaatgaagtggacgaaccacccaagaatcttttttgaagtggctgtcgtgaaaatatgccagacggcacagcaatccgccggagacatccctgaggtcggcatgctgatgaataagatccagcagcttgagcaggaagtagaaaggctgaaaacctccggtgtgaaggttcagatggaaagcgctccgaaagaagctccgcgtcctcaaaaaggcggaaaaagccattataaagccccggtcggaagaattcatgagatattgaaggaagccacaagacctgatcttgaacagcttaaaagcagctggggcaagctgctggcacacctgaaacagcagaataaggtatctcatgcggctcttttgaatgacagtgaaccggtggccgctgctcaaaaggcatttgtgcttaaatttaaatacgaaatccattgtaaaatggttgcagaagacaataacggagtccgtacgaatcttgaacagattctcgaatcaatgctcgggaaaagaatggatttgattggcgttccggaagcacaatggggtaaaataagagaagaatttttaaatgatcaccagcaggaaagtgaaggatcaaacgaaccggctgaagaagatccgctgattgcagaggcgaaaaaacttgtcggagcggatttaatcgaaataaaagactaataagatgaaagagagtgattgaatatgcgtggcggaatgggaaacatgcaaaaaatgatgaaacaaatgcaaaaaatgcaaaaggatatggcgaaggctcaggaggaacttgctgaaaaagtgcttgaaggcacagcgggcggcggtatggtgactgtaaaagtcaacggccaaaaagaagttgtagacgttgccattaaagaagaagttgttgatccggaagatatcgaaatgcttcaggacctggttcttgctgcgacaaacgacgccctcaaaaaagtggatgacatgacgaatgagacaatgggacaatttacaaaaggaatgaacataccgggtttattctagggggataaataaacatgcagtatcctgaaccaatatcaaagctgattgacagctttatgaaattgccagggatcggaccgaaaacagcggttcgtctggctttttttgttctaggtatgaaagaagacacagtattggattttgctaaggcgcttgtcaatgcgaagcggaatctgacatattgctcgatttgcggacatattacagatcaggacccttgttatatatgtgaggacacaagaagggataagtctgttatttgtgtcgtgcaggaccctaaggatgtgatcgcaatggagaaaatgaaggaatataacggccagtatcatgttcttcacggcgcgatttcaccaatggacggcatcggcccggaggatattaagattccggagctgctgaaacgtcttcaggatgatcaagtgacagaagttattctcgcaaccaaccctaatattgaaggggaagcaacagcgatgtatatatcaaggctgttaaagccctcaggcatcaagctctcccgtattgcccacggtctgcccgtcggcggtgatttggaatatgctgatgaggtcactctttcaaaagctcttgaaggaagacgtgaattgtaagggaggaaaaggcaaggcatgggttttcttcgcagaaatacattaagaaaagagtttgacgagaagctgatagaacagctctttaaacaaaaagaagaatggaacagacagaagagtctggtcgagaaaagtctagagccctccgctgaagtgttgtttgagctgaaagtcgctgaatctaagtactttttttatttgaaagaagcgaagcagcggaatttgaaaatgagcagatggaagtaagaggtctattctccggaatcttctcataagcttgtactaaacaagcgagggggaagattcatggagccttttttcattatcggtttgattgtcggtctggttgctttgctttttttatggggagtatcttcaaaaccgttaaggtggattggtgtgactgccattaagtttattgccggcgcgattctgttggtgggtgtgaacttgttcgggggcagtctcggtattcatatccctgttaacctgattacaacgggcatcagcgggattctgggaattcccggcattgcggctttgatagtcattaaacgcttcatcatttaatttgtcgattattgttgacatgttggatcatgggtggtattctaatatacgtcgctgatgacgaaacgaattcttgaaaaagaaattttaaaaagttattgacgatactgacactgagatgttataataattaagtcgcttcaagagcgatggacaaagttctttgaaaactaaacaagacaaaacgtacctgttaattcaaagttttaaataaatcgcacagcgatgtgcgtagtcagtcaaactaaggtctgcatgatgcagatcacacagacgttactgcaggatgcagtgaacttagtctgtgatccatttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggaactttaattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgcaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttttgaataaaaacaaaacaaacaccgaaatacgggaacgcccatatactaattgcaaacttcaaaaagatccaaattgtgtatacaatcaacagcttaagggaaggctattcatacggaggtgggcaaaatgaatgaaacgtccggccatgaagaaacatgtattgtgtgtgaaaccaagaaaagcaggggaatccatatttatacgaaatttatatgtttagagtgtgagaagaaagtagtttccactccgacctctgatccgaattatgaatttttcgttcgtaaactgaaaagccttcatacaccgacgttatattcttaaccctgaaaagggtcttttttttgcctgaaatcagaggagttttttcactttttataaaagaactgatacgataagaagaggaacttgtttagacatggaatgtaatagataatactgataaaagtgaataaataggagtcgatcaagtatgaaaccgtttattcaatatatgaaatggacgttttgcggcagcacagtttttgtattagcggggataaccttctttacgatagggcatcagccttttctgtattcgcttttatacggggcagccggtggagccgcagtcagtgcgtccggcttgtggaatgcgaagcgtctctttttaaaaaaacaccggctgacaagaaaagaatatgcttatatcaaggaaaatctcgaggaagcaaagggtaaaatcatccgattacgcagggcgcttttccgctcgaaaagtatacaaatgctgaagcagaatgcagagatactgcggataacccgacgaatatatctgctcacaaagcaggagccgaagcgtttttatcaggcagagcgtttctattatcaaacgcttgattctgttgtggaactgacggaaaagtatgctttgctctcatcacagccgcgaaaaaataaagatttatcaatgtccttgagtgagacgaggatgactctggcggagctttccagaaggctggaagaggatcttcatgaactgatgaaggaggacatcgacgacctgcactttgaattagatatggcaaagcattcactgagaaaataagaaaggaagaaggaaatggccaaagaccgttccgatgacagcataggcgcccaaaatgaccagactcatctaaagcttgcagatacgctgccggaagaaaaaagagaagcggcacttcagctcgctgaaaaactggaccctgggaacatgcaaagcattgttctgtttggttcacaggcgcaggcgaatcttctggaattttcccacacgatgatagagcacgtgcaaagaaaagatgcaggagagatgggacaaatattggctgatctgatgctgaagcttgaccaggtaaaccccgatgatctgcaggtaaagaacaaagggtttttcgcccggctgtttaaaagggtatccggatctgtgcaggaagtgctttcgaaatatcaaaagacaagtgtgcagattgaccgtatcagcagaaggctggaacattctaaaaatgtgctgttgagtgacaataaatggttagatcagctgtacgcccaaaataaacaatacttttctgatttaactatgtatatagcagcgggtgaattaaaattagatgagctgaaaacaaagcttattcccgaagcggcaagaaaagccgaattacgagaacacaatcaaatggccgcgcaggaagtgaatgatcttcgccagtttgccgaccgtctggataagagggtgcatgatctgctgctgagcaggcagattacgcttcagagtgcgccgcaaatccgtctgattcaaaacacgaatcaggcactggcagagaaaattcagtcctccattgttacggctattcctttatggaagaatcaagtcgccatcgcgctgacgcttatgaggcagcggagtgcggcagatgtgcagcagaaggcggcggatacgacaaatcaattgctgctgaaaaacgccgaacttctgaaaacaagcacagtcgagacggccaaagccaatgagcgcggacttgttgaggcagacaccctcaaaaaagtgcaggaaagcttagtcagcacacttgaagaaatcatgtctattcaagaagaaggcaggatgaaacgcaggcgtgccgaggaggagcttgttatcatggagggcgatttaaaaaagaaactgcttgatatgaagtccggccgggataacggctagatggcaaaaagtcttagctttaagttggctcgcaggcacgatataataagaaagacaggcaaaggatttgtttaaaaatggacacacctttatatacagcgctgatgaagcatgcgcaccgaaatacgtattcttttcatgttccgggacatcacaatggagatgtcttttttgatgaagcgaaatctgtatatcaatctcttttatctattgatatgactgagatcacgggtcttgatgacttgcatcacccgacaggggtcattaaggaagcgcaggatttggtgagcagattgtacggctctcaggaaagcttctttctcgtcaacggaacgaccgccggcaatctggcgatgattttagctgtttgtgaaccgggtgaacccattctgatccagcgtaattgtcacaagtctgttttccatgcggtgacattggccggagccaagccggtttatttggcgccggaaatcgatgaaaacatgcatgtgccggcacatgtatccctttcagtcatcgaaaaagcgctggcgtcatatccgaacgcgaaaggacttgttctgaccaatccgacttactacggacacgccgccgatttgactgcggcagttaaaaaagcccattcatacggtgttcctgtactggtggatgaggctcatggggctcactttgtgttaggccagcctttcccgccttcatcattggctatgggggcggacgccgttgttcaatcggctcacaaaacgcttccggctatgacgatgggatcttactttcatttaaacagcacccgaattgacagagatcgattaacttattatgtaagcagtttgcaaagcagcagcccgtcatacccgattatggcatctttagatacggcgcgtgcttatgtgcaggacattgctgaaaaagggacacttcccgtccatatggagcacattgagaaaatcaaacgaaggttcgcatcaatttcttctattgaaataatcgagccttccggatatgggatgtgggcggacccgttaaaattaatacttcggtcaaagctcggacattccggctattcattacaacgcattttggagagtgaaggcattgttgccgagctggctgacgagtaccaagtattgctcgtactgccgataggcggccggcggatgatagaacaggcagccgtaagaaacatacagcagaaactggagaatacaccgcccgataaattgccggatgccgtgaattggacatttccgtccatttcgacacttgaatatccgcaaaatgagatgcggaagtttacaaaagagcctgcagatataaataaggcggccgggcgcttgcatgcggggaacattattccttatccgccgggaattccgctgatcatggacggcgaacggataacagaagagatcgtacagaagctttcccgtttaatcggcatggacgcgcatattcaaggcttgttaaacggggaacaattacttgtctatatagaagaggagaaatcatgagcggtttatttataacatttgaaggtcctgaaggtgcagggaaaacgactgtgcttcaggaactgaaagagattctgtcggcagaggggctcccggtgacagcgacaagagaaccgggcggcatcgacattgcggaacagatcagagaagtgatcttaaataaaaacaatacactgatggatgcaaaaacggaggcgctgctttacgccgcggcgagaagacagcatttaaccgaaaaggtgcagcctgcattgaaagaagggcgcattgtgctgtgtgatcgtttcatcgacagttcgctggcttatcaaggctatgcgagagggctcggcattgatgaagttctttctatcaaccagtttgcaatcggcgatacgatgcctgatgtcaccatctatttttctattgagcctgaagaagggttgaaacggattacgtcgaatgattcaagagaaaagaatcgtctcgatcttgaggccctgcactttcacacgaaagtacgggaaggataccaaaaggttatgcagcgttttccggaaagattccatacaatcgacgcatcgaaaaagaaggaactcgtcattcaggacgcgcttcaagtgataaatgaagcattgaaaaaaattcagttgtgacctgtttctcataagttgctataatgaatgtaacgacaatgttctttccaacctaaagggggcctagagaatgaaattaatagtggcagtggtgcaggatcaggacagcaacaggcttttgaaagtattaaccgaccacaacttcagggtgacgaagcttgcgacaacaggcggattccttaaatcaggcaatacgacgtttatgatcggggtggaagatatccgtgtcgataaagcgctcagcctcattaaagagaatggctgtaaacgtgatcagatgattgccccggtatccccgatgggcgggaatgcggattcatacgttccatatcccgtcgaagtggaagtcggcggagcgacggtctttgtcctcccggtcgatgaatttcatcaattttaaggatttgacgacgtgaaaataaattctgacttacgtacatttattgagaaaaagcagcagcctgcttataaagcggcagagctttccggaacgtttaaaagttcaatggacagccaaagcagcaagctgaaatttgatcagctgagcaggttcttaacggatatagaaacgttcgggaaaaggctgacgaagtcgagaaacttcaaagacttagcgaaattcaaaggattggtaaaacgttttgtaaaagaggccgtagacagcggattatcgcatgagacggagaaaagctttgacttgtacggcagcagccggaccctggggcttgtgaaagaaatagatgaaaaactgcttcagctgacggaagaaatgttagatcaggaaaaaccggcaattgatttgctggatcgaatcggagaaataaaaggtttattaattaacctttacacatagagagtgatacaatggcaatatcatggaaggaaatgaccgggcagcagcccagagtgatgcggcttttgcataacagcattaaaaagaaaaggctttctcacgcatatctgtttgaaggcaaaaaaggtacgggcaaattggatgccgcactgcttctcgcaaaaagctttttttgccttgaaggcgggactgagccttgcggggagtgccggaactgtaagcgtatcgaatccggaaaccatcccgacctgcatgtggttcagcccgacggattatccattaaaaaggctcagatccaatcgcttcaggaagagttttctaaaacaggactggaatcgcataaaaagctgtacattatatcccatgcggatcaaatgacgacaaatgcggcaaacagtctgctgaagtttttagaggagccgagtcaagacaccatcgcaattctgattactgagcagctccaccgaatactggataccatcgtttcgagatgtcaggttctcccgttccagccgcttcagccgaaagccatagaagaaagactgattgaacaggaagtgagccctcacatggcccggctcttagcaaatatgacaaataatattgcggaagcagtcgaattaagtcgaaatgatgagtttgcagagtccagagcgaaagtgataaaattgtatgaagtcttacatcagcggaaaggacatgcctttttcttcattcaggatcagtgggtgccctttttcaaagaaaaaacccatcaagaaatgggtcttgatatgctcttattgatataccgtgatgtattatccatccaaattggaaatgaagataaactgatttatcaagacttattccaatcaataaaacagcatgcgctgcaatttacacaacaaagcgttacgaaccaaattctcgctgttttagaagcaaaaaaacggcttcattccaatgtgaatgtgcagggattaatggagcacttggtgttaacgttgcaggagggataagcttgtacaacgtaataggcgtccgctttaaaaaagcggggaaaatttattattttgatccgaacggatttgatatagaacaagacagctgcgtcattgttgaaaccgtaagaggtgtagaatacgggcaggttgtcatcgcaaataaacaagtggacgagcatgatgttgtgcttccgcttcgaaaggttattcgcgttgctgatgaacgcgatcttctcattgtagaagaaaataaacaggaggccctgtccgcttttgaagtctgtcagaaaaaagtggctgaccacggcttagatatgaagctggttgatgttgaatttacgtttgaccgcaataaagtcattttttactttacggcagacggacgggttgatttcagggaattggtcaaagacttggcttctatctttaaaacgagaatcgaattgcgccaaatcggggtaagggacgaggcgaaaatgctcggcggtatcggaccatgcgggagaatgctttgctgctccacgttcctcggtgattttgaaccggtgtccatcaaaatggcgaaggatcaaaatttatcgttgaacccaacgaagatttccggtctgtgcggccgtttgatgtgctgtttgaagtacgaaaatgatgagtatgagacggcaaaagaacagctgccggatttaggcgaaatgattacgacggcaaacggccccgcaaaggttgtcggtcttaatattctggaacgggtgcttcaggtggaactgaagaatcgtgaaaaagtgatagaatatacttgggaagagctcttggaagagggcgtcgtatccgcacaaaccacagattaacgaggtgtggaaccttggataaaaaagagttatttgatactgtcataaacctggaggaacaaatcggttcgctgtaccgtcagctgggtgacttaaagcagcatatcggcgaaatgattgaagagaatcaccatcttcagcttgaaaataagcatttgcgtaagcggcttgatgacacgacggagcaaattgagaagttcaaagccgatcagaaagaaacaaaaacacagaaggcagagcagagtgatataggagaagggtacgacaatctggcccggctgtatcaagaaggctttcatatttgcaacgtccattatgggagcgtccgcaagggagattgccttttttgtctgtccttcttaaataaaaaataaggaaaaggcttccgctgatgtcggaagcctttttcaaagagtgccgaaaggaataagattatggtttcattacgtgatgatgaaagattggattacttattagcagaggatatgaaaatagtacagagtccgacggttttcgctttttcattagatgccgtgctgctgtctaagtttgcatacgttccgattcaaaaggggaacatcgttgatttatgcacggggaacggcattgtgccgcttttgctcagcacaaggtcaaaagccgatatcaccggggttgaaattcaggaacgcttgtatgatatggcgctccgaagcgtggaatacaacgggctgggcggtcagatcagtctcattcatgatgatctgaaaaatatgccggaaagactcggacataataaatatgatgttgtcacctgcaatccgccttattttaaaacaccgaaagaggcggagcagaacctgaacgagcatctcagaatcgcaaggcacgaaatcctttgcacgcttgaagatgtgatttccgtcagcagcaaactgctgaagcaaggcggaaaagcggctctcgttcatcggccggggaggcttttggaaatctttcaactaatgaaagcataccgaatagaaccgaaacgggttcagtttatttatccgaaacaaggtaaagaagcgaataccattttggttgaaggaattaaaggcggccgccctgatctcaaaattcttcccccgctctttgtatacaatgaacaaaatgaatatacgaaagagatccgcacgattttatatggagacaaatagtcatttcttttatgtgctgctgtgcaatgacaacagtctgtatgccggttatacaaatgatctgcaaaaacggttgaaaacccacaatgagggaaagggcgcgaaatatacaagggcgagaaggccggtttcgttatgccatgcggaatcatttgaaacaaaacgggaagcgatgcaggcggaataccgttttaagcagctgacccgaaagaaaaaagagcaatatatagaagaaaaacgacgcagcaaggaggctgtatatgttaagacgccagatgagttttaacggaaaatctgaaatgggaactctgtaccttgttcctacaccgatcggcaatttggaggacatgacctttcgtgcagtagagacgctgaaatcggccgatgtcatagctgccgaagatacgagacagacgaaaaagctgtgccatgtttatgacatagaaacatctctcatcagctatcatgaacataataaagaaagcagcggccataaaatcattgaatggctgaaaagcggaaagaatgtggcattggtcagtgatgccggtatgccgacaatttccgacccgggggctgagattgtgagagatttcacccaaatcggcggatatgtcgttccgcttccgggtgcaaatgcggcattaaccgcgctgaccgcatcagggatcaccccgcagccgtttttcttctacggattcttaaacagacagaaaaaagaaaagaagaaagaactcgaactcctgaaaaaacggcaggaaacgatgatattttacgaagcgccgcacagattaaaagaaacattaacagcaatgcatgacgttttggggaatcgaaccatcgccgtcacgagggaattaacgaaaaagtatgaggaattcatcagaggaaccatcgccgaggtgcttgaatgggcaaacgaagatcaaatccgcggtgagttttgtctcgttgtcgaaggcaatcaaggcgctgaaccggatgaagaggaaaagccttggtgggcggagctttctgagaaagaacatgtggagcattacataaatgaaggatcttcttccaaacaggccataaaacaaacagcggtagatcgggacgtaccgaaacgcgagatttatgacgcttatcacattcaatcataaaaaaaaccgttcttgtgtcataacaagaacggtttttgtatgaaatagcttatttttggttttgaagctggttttgaatttcagagatgatttgctcagcgccttctttgctgagtaccaatttgccgccggcaagtttaaggttatcatcagaaacttcaccagttacttggcaagtcatgtttggtttatattttttaaggatgattttttcatcatcaacataaatttcaagagcgtctttttctgcgatgcccagtgtacggcgaagttcgatagggataacgacgcgtccaagttcatcaactttacgtacgataccagtagatttcattaacagtctcctcccgagagataattatttgtagtttatatttttcttcgtcattattcgacaaaattccttacattcctagcataacaaggtttccaataatcgtcaatctttttgtttgctattgtttgtaagaattagttcttatagtaagtaaagccttggaaatcctgaaataacaggctttttgactgctttttcgaacctattatcctactgaaaatccttttaaatcaagactttcgaaccaagatgttttatattagtagattatatacgacaaatttcgacatgttaagactttttttaatttcaataaaaatttttaattttatttactcttttacgcgcagtacgtatatatccttgatcttaaaggctaagatggtatcatagatagaggacaaatatcaatattgtatatcaaataaaaccgctctcgtcctttgggcgtgagcttttcgacattctgaatgggaggttgcaacatgccgcaagacaataatactttttatattacgaccccgatatattatccgagcggaaaattacatatcggccatgcttatactaccgtggccggcgatgcgatggcgcgttacaaaagattaaaaggatttgacgtacgctacttaaccggaacggatgagcacggacagaaaatccagcagaaagcggaggaagagaatatcacgcctcaagcttatgtggatcgcgcagttgctgaaatccaaaagctatggaagcagctcgacatttctcacgatgatttcatccggacgacggaaagccggcacaaagaaattatcgagaaagtgtttcaaaaacttcttgataatggtgacatttacctggatgagtatgagggctggtacagcatccctgatgaaacattctatacggaaacacagctggtggatgtggaacgaaatgagaagggtgaggttgtcggcggaaaaagccctgacagcggccacccggtcgaattaatcaaagaggagtcatacttcttccgcatgagcaaatatgcagaccgcctgctgaagttttatgaggacaatccttctttcatccagcctgaatcacgcaaaaatgaaatgattaacaacttcattaaaccggggcttgaagatttggccgtttccagaacgacgttcgactggggcgtaaaagtgccgggaaatccgaagcatgtcgtgtatgtatggattgacgcactgttcaactatattacagcgctcggttacgatacggaaaatgatgagctttacaaaaagtactggccggctgacgttcaccttgtcggtaaagaaattgtccgttttcataccatttactggccgattatgctgatggcgcttgatctaccgctgcctaagcaagtattcgcgcatggctggttattgatgaaagacggaaaaatgtcgaaatcaaaaggaaatgtcgttgatccggtaacgttaattgaacgctacggcttggatgaacttcgttattacctgcttcgcgaagtaccgttcggttcagacggtgtctttacgccggaaggtttcgtagaacggattaattatgacttggcgaacgacttaggaaaccttctgaatcgtacagtcgcaatgatccaaaaatattttgacggcgagattggttcatatgaaggaaatgtgaccgattttgattcagagctttcttccgtagccggtgaaacggttaaagcttatgaaaaggcaatggaaaacatggagttttcagtcgctttatcaacgctatggcaattaatcagccgtacgaacaaatatattgatgaaactgctccgtgggtgcttgctaaagatcaggaaaaagaaaaagaattacgttctgtcatgtatcatttagctgaatcattgcgtatttcggccgtattgctccagcctttcttgacgcagacgcctgaaaaaatgtttgcccagctcggagttgaggatcagtctcttaaagcttgggacagcattcagacattcggccaattgaagaacgcgaaagtgaaaaaaggggaaccgcttttccctcgtcttgaagctgaagaagaagtagcttatatcaagcaaaaaatgcaaggaactgctcctgctaaagaagaaaaggcggaagagccgcaagaagcagagcgtcttcctgaaattacgtttgatcaatttatggatacagaacttcgcgtcgcagaagtcttgtccgcagagccggtgaaaaaagcagatcggctgctgaaattgcaaattgatctgggctttgaacagcgccaagttgtatcaggtatcgcgaagcattacacaccggatcagcttgtgggaatgaagatcatttgtgtaacgaatttaaaaccggtaaaactgagaggcgagctttctcaaggaatgatactggcaggagaatcggacggcgttctcaaagttgtagctgtcgaccagtcattaccgaaaggcactcgaattaaataataggggcaaaaggtgtttcacgtgtaacattccgtcgaacaccttttgtttttcaacaagaaaggagtttttatgatgctttttgatacacatgcgcacttaaatgccgagcaatttgacacagacttagaggaagtcattgcgcgtgcaaaggctgaaaaagttgaacgaatcgtcgttgtcgggttcgacaaacccactatcacgcgtgcgatggagctgattgaggaatatgactttatatacgctgcgatcggctggcatccggtagacgcaattgacatgacagaggaagatttatcatggattaaggaactgtcctctcacgaaaaagtcgtggcaatcggagagatgggccttgattaccactgggataaatcaccaaaagacattcagaaagaagtatttcggaaacaaatcgctctcgccaaagaagtgaaccttccaattatcattcataatcgtgatgcaacggaagatgttgtcacaattttgaaagaagagggagcggaagaagtcggcggcattatgcactgctttacggggagcgcggaggttgcgcggcagtgtatggatatgaatttctatatttcattcggcggaccggttaccttcaaaaacgcgaagaaaccgaaagaagtagcaaaggaaattccgaatgaccgtttgctgattgaaacggactgtcctttcctgacaccgcatcctttccgcggcaaacgaaatgagccaagctacgtaaaatatgttgctgaacagctcgctgaattaaaagggctgacatatgaagaaattgcctcaattacaaccgaaaacgcaaaaagacttttccgcatgaactgacagaatgcgctgtcataacgtgtaaaagcttgtccgattcagtggatatgtataacggttctacaagcttccttctcctcataagataggttgtcgatatgtctctcttccttttttttctttgtttttgcataatgagggatacgctgaaggtttttcatcttcgagatgggagggttgacagcattttagatactctatataatctctccgaggagaaggaggcgtttttcatcacacaaaaaatgaaaaaactgttttccgtaaagcttggtaaaagcaaggttattcttattgcagctattattctgctgggcggaaccgggactgcatacggggcacatgagctctcaaaacaatcagtttctgtttccatcaacggcaagaaaaagcaaatacgcactcattcaaaaacggttggggaacttctggaagatttacatatagagacgagaaatgaagaccggattaccccgtctaagcagacagcattggcagacaacatgaatgtcgtgtatgatgctgcaaagcagatccgtgtgacaagaggcggagaagaaaagactttatggtcaacggcaaaaacagtcggcgcatttctgaacgaacagcatacacctgtgaatcagcacgataaaatagatccagcagcagatacgaaagtgacaaacggcatgaaagtcacggtcgacccggcttttcaggtcactgtaaatgatgcgggaaagaaaaagaaaatatggacgacttcgactacggtcgctgactttttaacgcagcataagatggacatgaaagacgaagataaagtaaaaccggcattacacgaaaagctcacaaaaaatcaggccggcatacaaatcactcgtatcgaaaaagtcaccgatgtagttgaggaaaaaatagcgtatcaagtgaaagaaaaagaagatgcgtctctcgacagcgggaaagaaaagatcgttcaaaaaggaaaagaaggcaaacttaaaaagcattttcatgttgtcaaagaaaacggaaaagaagtatcaagaaagcttgtcaaaaaagaaacatctgaaaaaagcaaagatcagatcattgcggtcggcacaaagcggcacagtcccaagattgagcagctcagtgcacctgtgaaagcatcttcggacgaaaacggatcttccggtaaagtgattaccgtgtcttccacggcttataccgcaagctgcagcggctgttccggccaaacggctacaggcgttaacctgacaagcaatccgaatgccaaagtcattgcggtagacccaagcgtcatcccgctcggcacaagagtccacgtagacggatacggggatgccgtggccgctgatacaggctcagccattaaaggaagacggattgatgtctttttccctgaaaaatcttcagcttaccgatggggaaagaaacaggtcaaaataaaaatcttaaattaattccgattcactcagagggttttgcgccctctgtttttttcgttataataggtaaagtgtattttcagtatattagacgtgacatgcaagcaaaggtttcgttttggatataaaaagtttttttggaggaagtaatgaaaattaaagaaattattgtagtcgagggacgcgatgacactgcgcgcataaaacttgccgttgatgcggatacgatcgagacaaacggttccgcaatcggagacgaagtcatcagacagattcggctggcgcaggaaacgagaggggtcatcgtgctgacagacccggattttccgggggaaaagatccggaaaaccatttctgaagcagtacccggctgtaaacacgcatttctgcccaaacatcttgccaaaccgaaaaacaagcgcggcattggcgttgagcacgcatccattgaaagcatcagagcatgtctggaaaatgtgcatgaagagatggaggcaaagccgagtgagatttcagctgaagatgtcatacaggccggtctgatcggcggaccggctgccaaaagacgccgcgaacgattgggcgacctgctgaagatcggctatacaaacggcaagcagcttcaaaaacggctgcaaatgtttcaaatcaaaagaagtgattttattgatgcgctcgatgctatgaggcaggaggaacaggatgaacaataaagatatcgcgacacctatcagaacgaaggaaattctgaaaaagtacggtttctcttttaaaaagagtctgggacagaatttcttaattgatacaaatatattggacagaattgtggaccatgcggaaattacggatcggaccggagtcattgaaatcgggcccggaatcggcgcgctgacagagcagcttgccaaacgggcgaaaaaggtcgtcgcgtttgaaattgatcagcgcctgctgcccattctcaatgatacgctgtctccatatggcaatgtaacgatcattcatcaagatgtgctgaaagcagacgtcaaatccgtcattgaagagcagtttcaggattgtgatgaaattatggtgacggcgaatctcccatattatgtgacgacgccgatcatcatgaagcttttggaagaacatcttccgttaaaaggaattgtcgtgatgctgcaaaaagaggtcgctgagcggatggcggctgatccttcctctaaggagtacggatcgctttccattgcggttcagttctatacggaggccaaaaccgtcatgaccgtcccgaaaacggtgtttgtgcctcagcctaatgtcgattccgccgtcatccgtctcttgcttcgtgacggcccggcggttgacgtcgataatgaaccgtttttcttccagctgattaaagcaagcttcgcacagcgccggaaaaccttgctgaacaaccttgtgaacaatcttccgggcggaaaagagaaaaaagctcaaattgaagaagttcttcaagaaacgaatattgacggaaagcggcgcggtgaatccctgtccatagaagaattcgcgctcttgtccaacggattgcataaagcccttttctaagagggctttttgttttgcgtcaccacttggactgccgctacataggctagaggagaaccttattcattcaactgcaagaaaagcttgaaacatcaagcgccgcagcggaaagaggtgcatttgccaagacttctttcatgatgaggcttagtctatttgtggagtgggtaacgtgcaatttcaaataggagatatggtagccaggaaatcctatcaaatggatgttttatttcgcattatcggtatagagcaaacaagcaacggaaattcaattgccatcctgcatggtgacgaagtcagattgattgcggatgctgatttttctgatttggagcctgtgagaaaagacgaacaggccatgagaaagaaaagagatgaaagcaggatgaatgaatctctcgagctgctccgccaggattataagctgcttcgggaaaaacaggaatattatgcgacaaatcaatatcagcatcaggagcactactttcatatgcccggaaaggtattgcatctggacggcgatgaggcctatttgaaaaagtgcctgaacttttatgaaaaaatcggtgtgccggtatacggaattcattgccatgagaaaaaaatgccggcgtcaattgacgagctgcttgataaatacaggccggatattttagtcatcaccggccatgatgcatattccaagcataagggagacgtgaacgatttaagcgcctacaggcattccaaacactttgtcgaaaccgttcagagagcgaggcgtaaagtccctcatttggatcagctggtcatattcgcgggggcgtgccaatctcattttgagtctttaatcagagcgggcgcgaatttcgcaagttcgccgtcacgcgtcaatattcatgcgcttgacccggtatatattgtcgcgaaaatcagcttcactccgtttatggagcggatcaatgtatgggatgtcctgagaaatacgctgacgagagagaaagggctgggaggaattgaaacgaagggtgtgctgcgtgtcggtatgccgtataaatcaaatggatgagtgataaaacccgcatatatttcgctatgcgggttaattattttacatattgatacataaatttccggaacttgtgaaaaataacgcagaaatcaatagaattttgtcaaaataattttgttgacaatgacttattaacgttgatataatttaaattttatttgacaaaattgggctcttgttgtacaataaatgtagtgaggtggatgcaatggcgaagacgttgtccgatataaaaagatcgcttgatgggaatttaggtaaacggcttacgttaaaagcaaacggcggccgccgaaaaacgattgagcgttcgggcattttagctgagacgtacccttctgtttttgtgatacaactagatcaagacgagaattcgtttgaaagagtttcatacagttatgctgatattctgactgagactgttgaattgacattcaatgacgatgcggcaagctcagtagcattttaatgggcagtgaaccttttgtttactgctttttgttttgccttctaaagctcttctaattattccctcgaaagtttcagccgattaaacggaagctataggtgtcacatgttttatcgtggcgtgcacgaatggtgatcaattctataaaaggggttgtttcgtttgggcagacgtcgtggagttatgtcagatgagttcaaatatgagctggcgaaggaccttggtttttacgatacggtgaaaaacgagggctggggaggcattcgggcgcgtgacgccgggaatatggtaaagcgcgcgatcgagattgccgaacagcagatggcggctcagaaccaaaataaccgataatgcagtggcccgggggacaatccgttccccggttttttctatcggctgtcaaaaccggcgtcaatttcggataagtacctccgggtctccaaatgtgatacaatgttcatacttatgtttagatggagaagtaggtgaaagctatgcgtattttagaaaaagcgccggccaaaatcaatctgtccctcgatgtgacgagtaaacgcccggatggttatcacgaagtggagatgatcatgacgacaattgatttggcagatcggattgaactgacagaactgcccgaaaacgttatcagagtggcgtcgcataatcgctttgttccggatgatcaaaggaatctggcttatcaggcagccaaactgcttaaagaacggtttcaagtcaaaaaaggcgtttcgattatgattacaaaggtgatccctgtagcggcagggcttgccggcggaagcagcgatgcggcagccacgctcagagggctgaacaggctttgggatttaaagctttctgtcgaagagcttgcagagcttggagctgaaatcggttcagacgtgtccttctgtgtatacggaggcactgccctggcaaccggacgcggtgagaagatcaggcacatcagtgctccgcctcattgctgggtcatgctcgccaaaccgacgatcggggtatcgactgccgaagtgtaccgccggctgaacttacagcaggttcggcatcctgatgtgcaggcgatgattgacgcgattgaagaaaaaagcttccaaaaggtatgcggacaattagggaacgtattggagtcggttacgctcagcctccatcccgaggtggcgatgattaaaaatcaaatgaaacgcttcggcgctgatgcggtgttaatgagcggaagcggaccgactgtattcggtttggttcaatacgaatctaaggtgcagcggatttataacgggttaagaggtttctgtgatcaagtgtacgcggtgcggatgatcggcgaacagaatgctcttgattaaatccgtatgttaagttatattatttttaaattattcggattttgggggtaagttcatgaagtttcgtcgcagcggcagattggtggacttaacaaattatttgttaacccatccgcatgaattaataccgttaacgtttttctcagaacggtatcaatcagcaaagtcatcaatcagtgaagatttaacgattattaaacagacctttgaacagcaaggcattgggacgctgcttacagtgccgggagctgccggaggcgtcaaatacattccgaaagtgaaacaggctgaagcagaagcgtttatacaggagctgggacagtctttagtaaatcctgagcgtatccttccgggcggttatgtatatttaacggatatcttaggaaaaccatctgtcctctctcatgtaggcaggctttttgcttccgtttttgcggagcgggagattgatgtggtgatgaccgttgcgacaaaaggaatccctcttgcttacgcagcggccagttatctgaacgttccggttgtcatcgtgcgaaaggacaataaagtgactgaaggctccacggtgagcatcaattatgtatcaggatcgtctaaccgcattcaaacaatgtcgcttgctaaaagaagtttggctacgggttcgaacgttttgattattgacgactttatgaaagccggcggcaccattaacggcatgatcagcctgcttgatgagtttaatgcaaacgtcgcgggaataggcgtcttggttgaagccgagggagtgaatgaacggcttgtcgatgaatacatgtcactgctcacgctttcaaccatcaatatgaaagacaaaacgattgagattcaaaacggcaattttctgcgattttttaaagaacagcatttaaagaatggggagacagaaaaatgacaaaagcaatccatacgaaacacgcgccggcagcgatcgggccatattcacagggaatcatcgtaaacaacatgttttacagctcaggccagattcctcttactgctgaaggagaaatggtaaacgatgatatcacagaacaaacgcatcaggtgttcagcaatttaaaagctgtgctgaaagaagcaggcgcttctctcgagacggttgtcaaagcaacggtatttattgctgatatggagcagtttgcggaagtgaatgaagtgtacggacaatactttgatgtacataagccggcaaggtcttgtgtggaagtggcgagactgccgaaagacgctctcgtggaaattgaagtcattgcgctggtgaaatcttaaatctcagaaaagtggttccggtctccgggatcactttttttatgcagtatatgatccccaaatatggtttatcacctaattgtgtatgtatatcctatattttcaaaaaaactttttgaaacgtgcaggaatttaaaaagaatcgtggaattgttagactaatgcttttatatagggaaaaggtggtgaactactgtggaagttactgacgtaagattacgccgcgtgaataccgatggtcgcatgagagcgattgcatccatcacgctggatcacgaatttgtcgtacatgatattcgtgtgattgatggaaacaatggtcttttcgttgcgatgccgagtaaacgcacccctgatggagaattccgcgatattgctcatcctattaattccagcacgcggggcaagatccaggatgctgttttaaatgagtatcatcgtttgggtgattctgaagcattagaatatgaagaagccggggcttcttaaacataacaaaatgtaaggactgctgataaaggctgacacaaggccttttccggcagtccttttttaaatctgatttttcagtaataaagcgattacatagaaaattcttgcactttttgatgtcttcttgaaatcaacagctatttaggatatatttttctatggataaaagggatattggaggccattaaatggataagcggtttgcagtgattttagctgccggaaaaggaacgagaatgaaatcgaagctttataaggtccttcatccggtatgcggaaagcctatggtagagcacgtcgcagacgaagctctgaaattatctttagcgaagcttgtcaccatcgtaggacacggcgccgaagatgtgaagaagcagctcggacagaaaagcgattacgctctccaagcagaacagctcggtacggctcatgcggtcaagcaggcaaaaccatttcttcacggagaaaagggtgtcacgatcgttatttgcggcgatacaccgcttctgacggcggagacgatggaagccatgctgaatgaacatacagacaaaggtgcaaaagccacggtgttaacggctgttgccgacgatcccgccggatacggaagaatcatccgcagtgaagacggcgccgttcaaaaaatcgtggagcacaaggatgcttcggagcaagaacgtcttgtgaaagaaatcaacacgggaacgtactgttttgataacgaggctctttttcgtgtcatcgaacaggtttcgaatgaaaatgcccaaggcgagtattatctgccggatgtgatcgaaatcctcaaagacgaaggcgaaactgttgccgcttaccagactggtaacttccaagagacgctcggagtgaatgatagagtcgctctttctcaggctgaaatgtatatgaaagagcgaattaacaaacggcatatgcagaacggagtcactttaatcgatccgatgaatacgtacatctcacctgacgcgcgtatcggacaagatacagttatttatcccggaactgtgttaaagggacaagctgaaatcggcgatgaatgtgtcatcggccctcacactgagatagaggacagttcaatcggcagccgcactgtgattaaacaatccgttgtcaaccgcagcaaagttgggaatgatgtaaatatcggtccttttgctcacatcagacccgattccgcaatcggcaatgaagtgaagatcggaaactttgttgaaattaagaaaacaaaattcggcgaccgaagcaaagcatctcatttaagctatatcggtgatgccgaagtgggcacggatgtgaatctgggctgcggctccatcacggtcaattatgatgggaagaaaaaatatttaaccaagattgaagacggcgcttttataggctgcaactccaatctggtcgcacctgtcacagtgggagaaggcgcgtacgtcgctgcgggttcaaccgtaactgaagatgtgccgggcgaagcgcttgccattgccagagcaagacaagtaaataaagaagattatgtgaaaaatattcataaaaaataatcctaaaatcggaggtttaccatgtctaacgaatacggagataagaatttaaagattttttctttgaattcaaatccagaacttgcaaaagaaatcgcggataatgtaggggttcaattaggaaagtgctctgttacaagattcagtgacggagaggtccagatcaacatagaagaaagtattcgcggctgtgattgctatatcattcagtctacaagtgcgccggttaatgagcacattatggaattgctgattatggttgacgctctaaagcgcgcttccgcgaaaacaatcaacattgtgattccgtactacggttatgcgcgccaggacagaaaagcaagatcacgtgaaccgattacggcaaaactttttgcaaacctgcttgaaacagcgggtgcgacacgcgtgattgcgcttgatttacacgcgccgcaaattcaaggtttctttgatattccgattgaccacttaatgggtgttccgattttaggccattactttgaaggtaaagacttgaaagatatcgttattgtttctcctgaccacggcggtgtgacgcgcgcccgcaaacttgcggaccgtctgaaagcgccgatcgcgattatcgacaaacgccgtcctagaccgaatgaggtggaagtgatgaacatcgtcggtaacgtggaaggaaaaacagcgattctgatcgatgatattattgatacggccggcacaatcacacttgccgctaacgcgctggttgaaaacggagctgcagaagtgtatgcatgctgtacgcaccctgtattgtcaggccctgccgttgagcggatcaataactctaaaatcaaggagcttgtcgtaacgaacagcattaagcttcctgatgagaaaaaaatcgaccgctttaagcagctttctgtcggaccgcttctggctgaagcgattatccgcgttcacgagaaacaatctgtcagctatttattcagctaaaccgaaactttaaggtttaaatcccagttattgtgggtattgttctaataggacgataaaacgataattaggatggtgctgaatatggcaactttaaaagcaaatgaaagaacagattttaaacgttcgacgcttcggaaaatccgtcattcaggacatgttccagggattatatacggtaaagaaataacgaatacgcctgtctctttagacagtgtcgaattgcttaaaacattacgggacgaaggaaaaaacacgattatcacaattgatgtcaacggaaatcagcaatcggttatggtgactgatcttcagacagacccgctcaaaaacgaattgacgcacgccgattttcaagtcgtgaatatgagtgaggagctggaggccgaggtgccgattcagctgacgggagaggcgaaaggagtcaaagacggaggcgttatccagcagccgctgcatgagctttcgatcaaggctaagccgaaggacatccctcagacaatcaatgttgatatttccgggcttgaaatgaatgatgtgctgaccatcgcagatctgactgctgacggcaattatacatttacaaacgacccggaagaagtcgtggcttccatccttcctcctaagcaggaagcattcgaagaagatgcagaaccgtctcctgaggaagagcccgaaggagaaaatcaataagcgctttaagacgtaacccgcccgaggttacgtcttttgtgctagaatgagaagaattacagcgatgttgagggaggatttacgatgcttgtgattgccggtctcggtaacccgggaaaaacctatgagaacacgagacataatgtcggctttatggccattgacgagctttctaaagaatggaatattgaactgaataaaacgaaattcaacggactttacggaatggggtttgtttccggaaaaaaagttctacttgttaaaccgcttacatatatgaatttatcaggggaatgtttgcggccgctgctggattattatgatgccgatcatgaagatctgaaagtcatatacgatgaccttgatcttccgacgggaaaaatcaggctccggacgaaggggagcgcaggcggacataacgggattaaatcgcttatacagcacctcggaacccctgaatttgaccgggtcagaatcggaatcggccgccccgtcaacggaatgaaagtcgttgactatgtactgggagcttttacgaaggaagaagcgccgcatatcaacgatgccgtctcaaaaaccgtaaaagcctgcgaagcttccttaacgaaaccatttttagaagtcatgaacgaatttaatgcaaatgtataagataaataatgggagaccatactagggaaaaatgattttttcacatcaggaggtccaacgtatggctttgcattatttctgccgccactgcggctttaaggtagggagcctggaatattcgacggtgccgacacagtcacttggatttcagcacttaacaaatgaggaaagaaacgatatgatttcatataaagacaatggagatgtccatgttcttacaatttgtgaagactgccaagaggcgctggaacgcaatccgcactaccatgaacacaacacatttattcaataagaagctttggtgtagattctagaccaaagcgtttttctgttcttgcagaaaatagagaggagggcccatatggacaacattcaaacctttattaaagaaagcgatgattttaaatccattgtcaacggtttacatgaggggctgaaggaacagctgcttgcgggtctgtcaggttccgcgcgttctgtttttacctccgcccttgcacaggaaacgaaaaggccgattttctttatcacccataatttatatcaggcccaaaaagtgacggaagatctgacggcgcttctcggggatcaatctgtttttttataccccgtgaatgaattgatttcttcagaaattgcggtagccagtcctgaactgcgcgctcagcggcttgatgtcattaatagattaacaaacggagaagcgccggtcgttgtggcgcccgttgcggcagtgagaagaatgcttccgccgaaggagctgtggaaaagcagccagctcgtcatttcactcggagacgatatagaaccggatcagctgtccgcgcgccttgtagaggtggggtatgagcgttccgatatggtttctgcacccggtgaattcagtattcgcggcggaattatcgacatttatccgctgacgtcggagcatccggtgcgaattgaactgtttgatacggaggtcgattccatcagaagcttcaattctgatgaccagagatcaattgagacgctcaaacatgtggcgatcggaccggcgaaggaattgatcatcagggcggaagaaaaagcccgggcaatggaaaggctcgataaagggcttgccgacagtctgaaaaagctgaagcaggacaaacaaaaggaaatgcttcatatcaatatctcacatgataaagaacggttatcaacgggacagactgatcaggaacttgtgaagtatctctcgtacttttacgaaaagcctgctagtttgctagattatacaccggcagacacgttgttattgttagacgaggtcagccgcattcatgaaatggaggatcagctgcaaaaagaagaggccgaatttacgacaagtctactcgaggaagggaaaattctgcatgacattcatttatccttcagctttcaggagcttatgagcgaaaagcggcgcccggctatttattattcattatttttgcgtcatgtccagcatacaagccctcagaatatcgtgaatgtgacaagccggcagatgcagagttttcacgggcagatgaatgtgctcgcaggtgaaatggagcgcttcaagaaatcaaacttcaccgtcgtctttttaggcgcaaataaggacagaaccgacagattggcatccgtgctggctgattacgaaattgaagccgcaaaaacggacagctccaaagcgcttgtgcaaggacaggtctatgtcatggaaggcgagctgcaatccggttttgaactgccgctgatgaagctggccgtcattacggaggaagagctgttcaaaaaccgaattaagaaaaagccgagaaagcagaagctgacaaatgccgaacggatcaaaagctattccgagcttcaggtcggtgactatgtcgtccacgtcaaccacgggatcggtaagtatttggggatcgaaacactagaaatcaaaggcattcataaagattacctcaacattcattatcagggcagcgataagctgtacgtccctgtagaacaaatcgatcaggtgcagaagtacgtcggctctgaaggaaaagaaccgaagctttataaactgggcggcagtgaatggaaacgggtgaagaaaaaagttgaaaactccgttcaggatattgccgatgatctgattaagctttatgcggaacgggaagcaagcaaaggctatgcgttctcgcccgatcatgaaatgcagcggcagttcgaatctgctttcccttatcaggaaacagaggaccagctccgttccattcaggagattaaaaaggatatggaaagagagcgcccgatggaccgtttgctttgcggtgatgtgggatacgggaagacggaggtagccatccgagcggcctttaaagcgatcgcagacggaaagcaggtcgcgcttcttgtgccgacgacaatactcgcgcagcagcattatgaaaccattatggagcgttttcaggactatccgattaacatcggtcttctcagccgattcagaacgagaaaagaatccaatgaaacgattaaaggcctgaaaaacggaacggtagacatcgtaatcggaacccacaggctcttgtctaaagacgtcgtctataaagatctcggcttgctcatcattgatgaagagcagcgcttcggcgtaacgcataaggaaaaaatcaaacagatcaaagccaatgtcgatgtactgactcttacagcgacgccgattccgcgtacgcttcatatgtccatgctcggtgtgcgggatttatccgttattgaaacgccgccggaaaaccgtttccctgttcagacatatgtcgtggaatacaacggcgcgcttgtacgagaagctatcgaaagagaactggcgcgcggaggacaggtatatttcttgtacaaccgcgtggatgacatcgagcggaaggctgatgaaatttccatgcttgttcccgatgcgaaagtggcatatgcccacggaaaaatgactgaaaatgaattggaaagcgtcatgctcaattttctggaaggggaatcagacgtccttgtcagcacgactattattgagacaggcgtagatataccaaatgtcaataccttgattgtgttcgacggagacaaaatggggctgtctcagctgtatcagctgagaggacgggtcggccgttccaaccgcgtcgcttacgcgtattttacgtaccgcagagacaaagtgcttactgaggtggcggaaaaacggctgcaggcgattaaagaatttaccgagctgggatcaggctttaaaattgccatgcgtgacttgacgatcaggggagcggggaaccttctcggcgcccagcagcacggctttatcgactcagtcggttttgacctgtactcgcaaatgctcaaggaagcgattgaagagcggaaaggcgatattccgaaaagcgaacagtttgagacagaaatcgatatcgagcttgacgcgtatattcccgaaaactatatacaagacggcaagcaaaaaatcgacatgtataaacgcttcaggtcaatcgccacaattgaggagaaaaatgagctccaagatgaaatcattgacaggttcggcagctaccctaaagaagttgaatggctgtttacggttgctgagatgaaggtatacggaaaatatgaacgcgtcgaactcatcaagcaggataaagacgcgatcagatttaccatttctgaagaggccagcgcacagattgacggccagaaattattcgaactcggcaataaatacggccggcagatcggactgggaatggaagggaaaaagctgaaaatctcagtacagacgaaaggccgcaaaacggaagagtggctggagaccgttctcggcatgctgaaaggacttcagaatgtgaagaaagaaacaatcgcatcttcataaaaattgttactctctggtgtatattacatttgatgtgacggatactaatttcaagcgagtggcggaagctacataaagtaaagagctttagtactttcccttaaatatcatcacatgaaagagaggcaccagagagatgaaagctacaggtatcgtacgtcgtattgatgatctaggacgggtcgtcattcctaaagaaattcggagaacactgcggatcagggaaggagacccgcttgaaatattcgttgaccgcgacggagaagttatattgaaaaaatattctcctatcagtgagcttggcgattttgcgaaagaatatgcagatgcattgtatgacagtctcggccattccgtcttgatttgcgaccgtgacgcgtatattgccgtttcgggcagttcgaaaaaagaatttctgaataaagccatcagcgatttgctcgaaaaaacgatggatcagcgcagctcagtggtagaaaacgacgtgaagtccgcgcagcttgtgaatgacgttgatgaagatatgagctcctatacaatcgctccgatcgtggcaaatggcgatcctatcggggccgtggtcatcttttccaaggaacaggcgcttggagaggtagaacataaagcggtagaaacggcagccagttttttggcgaggcagatggagcagtaggtcttattaccattattgaaataagaaacggggaaagaacagctcttatacaagtgctgttctttttcatattcatatgtgctctctatcggttcggccgttaggattgtgatataataagctcgttttatagacgtaattttctagcggctggaaggagcttttggatgaacgattcagttggcgccaagcggcaatcggcatggaaaggtgcttttgtgctcgtcgttgcgggcatcgtgacgaagatattaagcgccgtgtacagggttccttttcagaatattgtcggtgacgtcggattttacatttatcagcaggtgtatccgtttttagggatcgcggtcatgctgtcaacatccggttttccggtgatcatctcaaaattaatgaacgattatagcgatcataaacaaaaaataatgaaaatttccgccctttatgtcacggcggccggacttgttctgtttgcgctcatgtatgccggcgcggcgccgttggccggttttatgggtgacgcccgccttgtgatgctgataagggtcgcggcgttcgctttcatactgtttccgtttacggcggttatccgggggtatttccaaggcgtgcatgatatgatgccgtcagccttatcccagattacggaacagtttcttcgggtggcggtgcttctcggtttatccttctggcttttgaaaagcggccgttcattatacgcggcgggtgcgggggcggtctcgggatcaatagccgggagctttgcggccctttgtgtattggctgttttctggtataagcgggaagaaacaaagaaagacggcggacatatcaaaacggccgtcattgtaaaaaagctgctgctttattcagtcaccatctgtatcagcagtgtactcatgcttttgattcagcttgtagacgccttgaacttatattcactgctttcagacgggacggagagccatgccgcgaaacagctgaaaggcatatatgaccgcggacagccgctccttcagctgggaaccgtgtttgccgtcagtatcgccgcatctcttgttccttccatttcaaaagcggtgcatgggaacaagccgtttatcataaaagagaaagcgacatcagccgtcaagctctgccttgcggtagggatcggcgcatcggccgggcttttttgcattttagaaccggtgaatatcatgcttttccaaaacagtgaggggacgcagaccttacaaatattcagcttatctatcttttttgcctcaattgcgcttacggcagccgcgattctgcaaggagcgggacatacggttttccccgccgtatccgttttggcgggaggggcgctgaaatgggtgctgaatgtttggctggtccccggctggggtattacaggagcggcactggcgaccgtcttggcatttgccgcagttgcgtgcctgaatctccggagaatttggtcgaagggatggctgacgaatatcggaggcgtgattgcccgtctgtgctggtgcagtctgctgatggtcttctttttgctcgtatatatgaagctttggcagttatttgttcctgtcagcagggtcggagctgtatgtgagagtctgtctgcgtcaatcatcggagggctattgtttatttattgtatgataagaatgaagattttcacggacgaagagctgagcggccttccttttggcagtgctttaagcaaattgaaaaagaggagagaaaaacatggcaggtaatattacggtcgtcggcctcggcgccggagacatggatcagttgacagtgggcgtacataagctgctgactcaggcgaagcatttatatataagaacgaaagaccaccctttgatttcggaattagagcaagagacggaagcggacatccggtattttgatgatatttatgaaaaacatgatcagtttgaagcagtctatgaagagatcacggacattctgtttgaaaaagcgaagcaagaagatgtcgtctacgctgtacccgggcatccgtttgtcgctgagaaaaccgttcagctgttatttgaacgccgggaagaacaacagatagctgttcatactgccggagggcaaagctttctggatgccacttttaatgcattgcgaattgatccgattgaagggtttcaatttacggatgcgcaaacaatgacgccggatgagctcgaactccgccatcacctgatcatctgccaggtttatgaccaaatgacggcctctgaggtgaagctgacgctcatggagaaattgcctgacgactatgaagtggtcatcgttacggcagccgggagccagggagaaaagatgaccaaggtgcctttgtttgaacttgaccgcaatgtagaaataaataacttaacaagcgtgtatgttccgccgattaaaaaagaagaactcctttaccaggaattttctgcattccgaagtattattcgcgagcttcgcgggccgaacggctgtccgtgggatcaaaagcagacacaccagtcattaaagaaatatatgattgaggaatgctacgaactgcttgaggccattgacgaagaggacacggatcacatgatagaagaactcggggacgtcatgcttcaggttatgctgcacgcccagatcggagaagacgaggggtatttctcaattgatgatgtcatcagagacatcagtgcgaagatggtcagacggcacccgcatgtgtttaaggatgttaaggttcaggatgaacatgatgtcgtcgccaactgggaagaaatcaaaaaggcggaaaagcaaacaacatcctcttcattgctggatgccgtaccgaaaaccctgccttctcttgcgaaagccgccaagcttcagaaaaaagccgcaaaaaccggctttgactgggataacgttcaggacatatgggataaagtaaatgaagagctgaaggaattttctgcagaggcttccgccgaatcagcagatgaaatcagcttaaaagctgaattcggcgatgttttatttgcattggtcaatatcggccgatactataaaattgagcctgaggaagcgctcgccatgacaaatgacaaattccgcagacgctttgcttatattgagaaagaagcggcagcaaagggccttgaattgaccgcaatgtcacttgaggaaatggacaaattgtgggatgaagcaaaagaaatggagaggagattctgatatgagacttgataagtttttaaaagtatccagattaattaaacgccgcacattggcgaaagaggtcgccgatcaagggagaatcaccgttaacgggaatcaggcgaaagccagctcagacgtaaaagctggtgatgaactgaaggtccgcttcgggcagaagcttgtcaccgtgaaggtaaatgaattgaaagaaacaacgaaaaaagaagaagccgcgggcatgtatacaatcgtcaaagaagaaaaactcggcgaataggcttgttctaaacaaggctcccgcctcatacaatgcagtaataatgctaaaagtatcgaggatatgggggctgaatagatgaattcatattatgagcaaaaaggttcttcttctgttccggaacagcatgatgtaacgatgaaagggagaaagcatttagacatttcgggcgtcaagcatgtggaaagttttgataacgaagagtttttgctggaaacggttatgggaatgctttccgtcagaggcgagaacctgcagatgaaaaaccttgatgtggaaaaagggattgtatctataaaaggcagggtgtttgaccttgtatatctagacgagcagcaaggggataaagctaaagggttttttagcaagttgtttaaatgacgctgacgacccaattttatacgatgctggcaatgaccggtatgggcgcctggctcggagcgtcgcttgatacatacaggctgtttgtcagccgcgccaaaacggccagatggctgttattcattcatgacattctcttttggattgtacaaggtctgctgtttttctatgtgctgctcaacgtgaatgaaggagaactcagggtatacattttcttggctgtcttactgggtattgcgacgtaccaaagcctgtttaaacgaatgtatataaaaatactgaaatttgccattcatcttgcggtgtctctttaccaattcgcaaaaaagctcattcagcacgtgctgttccgtccggtgcttctgctctttaagctgctcatcgggctgatcacggttatttctttatactcctatcgggtgagtgccttttttgcgaagtgtctttttaagatcgtagcgtttttgctgtatccgctgtttttcctgttgaaacaattattgaaacttcttcctgaaaagtggcgtcttactttcaaacgatattttcaaaaaagtgcaggatttttacaaaagagcaagaaactaatcataacaatcagatcgaccatgatacgtattttgaaaaggtgaaaggaggaccgtctggtttgaatctatctagagaacgtacaataactgaaattcaaaacgactataaagagcaggttgaacggcaatcccagcttatgaaaagaaggcggaaagggcttttcagacggttgatcgtattcggcgcccttgtgttgttgacggctattgtcttagcgggttctctgtggtcacagacctcttcccttagcgcaaacgaagaaaaaaaggctcagctggaaaaacaagtaaaagaattggatgcgaaacaggctgatttaaaagatgaaatttccaaattaaaggatgaggattacgtcacagagcttgccagaagagacttgtttatgtcaggaaatggtgagattctctttaatgtagaaaagaagagcaagtagccttgttgacacttaaatttttatttaggtataattaaacaaacgatctttttataagcctaaggaggagcactttttttatgtcgattgaagttggcagcaagttgcaagggaaaataacaggtattacaaatttcggagcatttgttgaattgcctggaggctcaaccggtctcgttcatatcagtgaggtagccgataattatgtaaaagacattaacgagcatttaaaagtcggcgatcaagttgaagtgaaagtcatcaacgttgaaaaagacgggaaaattggtttatcaattaaaaaagctaaagaccgtccgcaagccagacctagaaatgatttccgtccgaaagaatcttttgaacagaaaatgaacaagtttcttaaagatagcgaagaccgcttatcatctttaaaacgaaacacggaatcaaaacgtggagggcgcggagcaagaagaggataacttgctgctttctataaatacatggagcatccgtctatcccagcgggtgctttttttgtatgcgcctttatagtcagaaaattaaaactttgaagtttctgttgacggaatgaagaaacctttgtattatataacttgtgcttataagcacctatatggcggtgtagctcagctggctagagcgtacggttcatacccgtgaggtcgggggttcgatcccctccgccgctaccatatatatctggcccgttggtcaagcggttaagacaccgccctttcacggcggtaacacgggttcgaatcccgtacgggtcatcaagcgaatcggcttctgttgcagaagccgattttttcatatttagacaactttttgagaaatgtcggaggaaatacgaaaggaaaggggaacaagggagaaagcgtcgaagagttctttggaattgttaccttcttttgacaaaatcctatctgtgctttcatttataatgacaagcaacgaataaaacaggtgggggatgagagcaatggaaaaagcggaaagaagagtgaacgggccgatggcgggacaagctctggaaaaactgcaatcgttttttgaaaaggcggcaaagcttacagtccatcaagcgcattcactttttttctataagggtttcatttatgtcgtgatcggttttttacttggacgggctttcatattatctgaggttcttccgtttgcactgccgtttttcggagcgatgcttttgatcagaagagataaagccttctatgcttgtctgtctttgcttgcgggcgctttaaccatttcgccgaaacactctttattgattctcacagctttggccgtcttcactctattttcaaaaatcggtacatatatcgtgcaggaccgggtgaagatgctgccgatcgtggtgtttttctcaatggctgccgcgagaatcggatttgtttattttgaaagcggcgcttttacaacctatgattatgtgatggctgttgtcgaggcgggcctggcctttattttgacgctgatctttttacaaagcctgccgattttcacgatcaaaaaagtgaagcaatcgttaaaaatagaagaaatcatctgttttatgatcttgatcgcatctgttttaaccgggcttgccggtgtttcatttcagggaatgcaggctgagcatatcctggcccgctatgtcgtgctgagtttttcctttgtcggcggggcaagcatcggctgtacggtcggtgttgtgaccggactgatcctcgggcttgcgaatatcgggaatctctatcaaatgagtctgcttgcgttttccgggcttcttggcgggctgctgaaagaaggaaagaaagccggcgccgcagtcggattggtgatcggctcactgctgatttcattatatggagaagggtctgccggattaatgaccactctttatgaatctttgattgccgttgttttgtttttgattacgccccaatcgattacgaaaaaggtggcgcgatacataccgggcactgctgagcacagtcaggaacagcagcagtacgcgaggaaaatcagagatgtcaccgcccagaaagtagaccagttctccaatgtgtttcatgccttgtcggagagcttcgccatctttcatcagacgtcttccgatgagcaggcggaagaaggggaagtggatctctttttaagcaaaatcaccgagcattcctgccaatcctgctataagaaaagcaaatgctgggttcaaaactttgataaaacatatgatttaatgaaacaagttatgcatgaaacagaggaaaaacagtatgcctcaaaccgcagattaaaaaaagagtttcagcagcactgttccaaatccagacaggtggaagagctgattgaggacgaacttgcccaccatcacgcccatctgacactgaagagaaaagttcaggacagcaggaggcttgttgccgagcagctgttgggggtttctgaggtcatggcggacttttctcgggaaataaaacgggagagggagcagcattttattcaggaagaacaaatgatagaggcgcttcagcatttcggaatcgagattcagcatgtcgagatatacagcttggagcagggcaatattgatatcgaaatgacaatcccgttcagcggaggacacggtgagagtgagaaaattatcgccccgatgctgtctgacattcttgaggagcagatacttgtcaaaagcgaacagcactcggctcatccgaatggctacagccatgttgcgttcggttcgaccaaatcgtaccgggtatcgacaggcgcggctcatgcggctaaaggcggcggccttgtctccggcgacagctacagcatgatggaactgggggcgagaaaatatgcggccgcgatcagtgacggcatgggcaatggggcgagggcccattatgagagcaatgaaacgattaagctgctcgaaaaaattctcgaatcaggtattgatgaaaaaatagcgatcaaaacgatcaacagtattctgtctttacggacgacagatgaaatctactcaactctcgatctttctatcattgatcttcaggatgcaagctgcaaattcttgaaggtcggttcaacgccgagttttatcaagcggggagatcaagtcatgaaagtgcaggccagcaatctgccgatcggtatcatcaatgaatttgatgtggaggttgtaagtgaacagttaaaagcgggagatctgctcgtcatgatgagtgacggtatttttgaaggaccgaagcacgttgaaaaccatgacctgtggatgaaacggaaaatgaaagggctgaaaaccgaagatccgcaggaaatcgctgatatattaatggaagaggtcatcagaacgcgttccggccaaatcgaagacgatatgacggtggttgttgtccggattgatcacaacacgccgaaatgggcttccataccggtgccggcggtattccaaaataaaaaggagatttcttaatcctttcgtataaatcactttccttctggcgaagatgggactaatcgtatcaccgggaggaatgtatgtgaataagggacatttaaatcaagttctgctgattacagatggctgctccaatcatggtgaagacccgattgcaatggcggctttcgccaaggagcaggggattacggtgaatgttataggaattatggaagaaaatgcgattgaccaagaggcaatgaaggaagttgaaggcatcgccatggccggtggcggcgtccatcaagttgtgtacgcgtcacaattgtctcagacggttcaaatggtaacgaaaaaagcaatgacccagacgctgcaaggtgtcgtcaatcaagagcttaaacaaatcttagggaaaaacgttgaaatggaagagctttctcctgaaaaacggggcgaagtgatggaagtggttgatgaactcggagaaacagttcatctgcaggtgcttgtgctggttgatacgagtgcgagtatggcgccgaaactgccgacggtgaaagaagcgctgatcgatctttccatcagtttaaattcccgggccggacaaaatgaatttgccatgtgtatatttcccgggaaaagccaggaagttgagcttgtgctgaattggacgccgaagcttgaatccctttctgcactctttgcgaagctgtcgaccggcggtatcacccctacgggccccgctatccgggaagcgacgcagcagtttgagagaatccgctcaagaaggagcatgttggcagatgatgaacgacgctttaacgagtttggcatgtagtctggcaccggggacggcaattcagggcaaatggaacggcaaatcctacagattgctcaaacagcttggaaaaggggctaacggtattgtatatctggcagaagcatcaggcggacaggtcgctttgaaaattagcagcgacagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcctgtcagtccttcatcagcagggatgggtgtttggcgacctcaaaccggaaaatcttattgtaaccggaccgccggctgccattcgctgcattgatgtagggggaacgacaaaacaaggccgcgcgattaaagagtatacggagttttacgacaggggctattgggggtatggaacaagaaaagcagaaccatcctacgacctgtttgctgtcgcaatgatcatgatccactgtgtccagaagaaagagtgcaaaaagtcaggacagccgaaagaacagcttcgttctatcattgaaggccacccgtttctgaataagtataagaaggttctgttttctgctttaaacggccaatatccgtctgcggaagccatgaagcatgacatcctgacggcggggcagagcgccgggagtaaaaggaaagccgccgccaagcctaagccgccgcaatcaaaaccgcggccgggcgctgtatctcaaacgcgatataaacctaaacaaaaacccgcaaagcacaatggtttgtttgaaacaacacttattttaatcagcgttctcgccctttatttcgcttacatcgtcttttttctcatctaatgccggccggacgcctgcgctcatgcttcttctttgcttggagggaatgaaagtgataggatatgtatatctttaaaaaacctgctcattgtgagggggacattgtgaaaagcgtggaagattttttcaaaacatatcatcttcaggcggagggagaaacgattattgccggggtctccggaggccctgattcaatggcgcttctcagtatgctgaataagcacttcgggcattcttccgttatcatagcggcgcatgtcgaccataagttcaggggtccaaattctgaagaagatatgaagtttgtgcagtcatattgcgaagcggaacacatcctctgcgaaacggtacagattgatgtttctgcatacgcaaaaaagaataagctgaacaagcaggctgccgcgcgtgattgcagatatcagtttttcgaagatctgatggcaaaacaccaagcgaagtttttggcgctggctcatcacggcgatgaccaggttgagacaatgctcatgaggcttgcgaaaggtacgctcggcgcagggctcgcgggaatgcagcccgtccgcgaatttgcatccggctggctgatcaggcctttcctctatgcggcaaaggatgaaatcctagaatactgccgtcaagaagggctcagctacagaacggatgagagcaatgcaaaagacgattatacaagaaacagattcagaaagaccgtgcttccttttttaaaacaagaatcacctgacgttcataaaatgtttcaaaaggtgagtgaagcactgacagaagacgaacaatacttgcagtcattaacgaaagaacgaatgaataaggttattacaagcaagtctgacacatcggttgaagtcgattcctctcaattgcttgcccttccgatacctttacaaagaagaggagttcaactaatattaaactatctttatgaaaacgttccatcgtcgttttccgcccgccacatacagcagtttctggaatgggcggaaaatggaagcgcctcgggagtgcttgattttccgaaagggctgaaggtggtcaaatcatatcagacatgtttgtttacatttgaacaatggcaatgtgaaaaggttccctttgagctgcagctgcaaggagcggaaggcgagactgctgttctccccaacggctttatgatagaggtggccgatcaggctgaccctcatatcaaaaatgggaatgctgtttttatgacaagcagaaataaggtgcaatttcctttaacaatccggacgagaaaaatcggcgaccggattaaacttaaagggatgaatggctcgaaaaaggtaaaagatatatttattgatcataaactgcctctgcgggatcgggacgaatggccgattgtaacggatgcgagcggtgaaattatctggctgcctggcttgaaaaaatccatctttgacgatcttgtgatttcaaacagtgaccgcattgtattacaatatagacagcatgaaaagtgtagggggcaagcattaacatgaaacaggatatcgaaaaagtgctgatctcagaagatgagatccagcagaaagtaaaacagcttggagaacaattaacaagcgagtacagcgacacgtttccgttggcaatcggtgtgttaaagggagcgctcccttttatggctgatcttataaagcatattgatacatatttggaaatggacttcatggatgtatcaagctacggaaattccacggtttcttccggagaagtcaaaatcatcaaagatttggatacatctgtagaaggccgggacatcttaatcattgaagatattatcgacagtgggttaaccttgagctatctcgtagaactcttccgatatcgtaaagcgaaatcaattaagattgttaccctgttggataaaccaagcggaagaaaagcggacattaaagcagacttcgtaggctttgaagttcctgacgcgtttgttgtgggttacggacttgattatgccgagcgctatcgcaatctgccttacatcggagtattaaaaccggcgatttatgaaagctgatcggctgcctgcttccgagatggttatcggttgtattggaatgattttctatggtactattgaacatagttgtgcttactgtgggaggaggtaaggaatgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgataaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagcgggcgttcctttcttcagcatcagcggatctgacttcgttgaaatgtttgtcggtgtcggtgcttcccgtgtgcgtgatttattcgaaaatgcgaaaaagaatgcgccttgcctgatctttattgatgagatcgacgcggtaggacgtcagcgcggcgccggtcttggcggcgggcatgatgaacgcgaacagacgctgaaccagctgcttgttgagatggacggtttcagtgcaaatgaaggaatcattattatcgctgcgacaaaccgtgcggacattcttgaccctgcattgctccgtccgggacgttttgaccgtcagattacggtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgtgtcatctcgaaaaaagaacgcaatatcgtggcgtaccacgagggcggtcacaccgttatcggacttgtgctggatgaagccgatatggttcataaagtaacgatcgttccgagggggcaggcgggcggatacgcggtcatgcttccgagagaagaccgttacttccagacaaaacctgaacttctcgataaaattgtcggtcttctgggcggacgtgttgcggaggaaattatcttcggcgaagtcagcacgggggctcacaatgacttccagcgggcaacgaacattgccagaagaatggtgacagagttcggtatgtcagaaaaactcggaccgcttcagttcggtcaatctcaaggcggtcaagtattcctgggccgggatttcaacaacgagcaaaactacagtgatcagatcgcttacgaaatcgatcaggaaattcagcgcatcattaaagaatgttatgagcgtgcgaaaaccatcctgactgaaaatcgcgataagcttgaattgattgctcagacattgcttgatgtggaaacattagatgcggaacaaatcaagcatctcgtggatcacggaaaactccctgagcgcaatttctcagatgaccatcttcaaaaagacgatgtgaaagtaaacatcctgtctaaaacagaagacgaaaagaaagacgagccgaaagaatagttcgctttctgatatgaaaaccgccggcgtataccggcggtttttttactggtttcgttttgtttacaaaagagccgcagatcgtgtatggtattgtagaatgttgaaaatgttatgattagaaactattcaaaagtggtgatagaggttgttactggttatagatgtggggaacaccaacaccgtgattggtgtatatcatgatggggaactagaatatcattggcgcatagaaacgagcaggcacaaaacagaagacgaattcggcatgctgctccgctccttatttgaacattccggactgatgtttgaacagattgaagggattatcatctcatccgtagtgccgccgattatgttctctttagaaagaatgtgcacaaaatactttcacatcgagccgcaagttgtcggcccgggaatgaaaacaggtttaaatataaaatatgacaatccgaaagaagtgggagctgacagaatcgtcaatgccgttgcggcgattcagcagtatggcggccccttaattgttgttgatttcggaacggcgacgacgtattgctacattgatgaaaacaaacaatatatgggcggcgcgattgctcccggcattacaatttcaacggaagcgctgtactcacgcgcggccaagcttccgagaattgaaatcgcccgaccggacaatatcatcggcaaaaacacggtaagcgccatgcagtccggcatccttttcggctatgtcggacaagttgaaggcattgtaaagcggatgaaatggcaggccaaacaagaaccgaaagtcattgcgacaggtgggcttgcgtcattaatcgcaaatgaatcagactgtattgatattgttgacccgtttcttactttaaaagggctggaaatcatttatgagcgaaatcgcgtgggtcacgtataggaggtaaacgatggattatttaattaaagcaattgcatatgatggtaaagtgcgggcttatgcagccagaacgacagatatggtaaatgaagcgcaaagaaggcatgacacgtggccgacggcatcagccgcaatcggccggacgatgacagcgtctctgatactcggagcgatgcttaagggtgaagataagctgacagtcaaaatagaaggcggcggcccgatcggagccattgtcgcagatgcgaacgcaaagggtgaggtaagagcatacgtatcaaacccgcacgttcattttgacctcaatgaacaaggaaaactggatgtcagacgggcggtcggaactgacggaacactcagtgtcgtaaaagatttgggcttgcgtgattattttacgggacaagtagagattgtctcgggtgaactcggtgatgacttcacgtattaccttgtttcttctgaacaagtcccttcatctgtcggcgtaggtgttctagtaaatcctgataacacgattctcgctgcgggcggattcatcattcagcttcttccggggactgatgaagaaaccatttcaacaattgaaaagcaattatctcaaatcgaaccgatttcaaaattgattcaaaaaggcctgacaccggaagaaatcttagaagaagttctgggtcaaaaaccggacgttctcgaaacaatgccggtcaaatttcactgttcttgttcaaaagatcgattcgaaacggccattttaggactaggcaaaaaagaaatacaagatatgatagaagaagacggaaaagccgaagcggtttgccatttttgtaatgagaaatatttatttacaaaagaagaactggaagagcttcgtgacgaaacaacccgctagctctttagcgggttgttctattttataaaagggatggggtagattttgaaatcgagaacacttttgacgattattgtagcggcgctgttggtatgcagtgtgacagtggcgtataagttaacaaaatcccaagccgcggggtcatctgaagaatccatcgcgacaatcggtgataaacatatcacacggcaggactggatgaaaaagatggaagacgagtacggaaaatcaactctggaagacatgattaatgcacaagtagtggaagagcttgcgaaaaagaataaactcacagtttcaaacagcgaattggagcgggaatttcttttaatcaaagcggtgaataattcattttatgaagacagccatattaccgaaaaagaatggagagaccagatccgctacaacattcttcttgaagaactgctgacgaaggacatcgatatatcggataaggaaatgcaatcattttataataaaaataaagaactgtatcatttcgatgattcctacagaatcaggcacattgtcgtcaaaaacaaggaagaggcggacagggtgcttgctgatttgaaaggcggttccagctttgaagccgtcgccgctgagcgttccacggacagatacacgtctcagtacggcggagacctcggctttgtgacagaaaaccaggaaaatatcccgcaggcatatatcacagaagctaaaaatctcaaagaagatgaatggtccgctgaaccgattaaagtttcttcaggatatgccgtcattcagctgaaagaaaagcttaaagcgagaactttctcatacaatgaagtgaagagtcaaatcagacgccagatcgcgatggatcaattaggtgacaaggcgacagtcaaaacgctgtggaaagaggcgggggtctcttggttctacggggaaaaaagaactaaatgattgacaaaaaattttgaaattgataacttatatttataataccaataaatttagtcggaaattgaggtgtccaacatggtgcgtattgcaaattctattactgaactaatcggaaatactcctattgtgaaattgaatcgcctgacggatgaaaacagtgcagatgtatatctgaagcttgaatacatgaatccgggcagcagcgtaaaagaccgtatcggagcggcgatgattgaagcggctgaaaaagaaggaaaattaaaagccggcgacacaatcattgaaccgacaagcggaaatacagggatcggtcttgcgatggtggcagcggcaaaaggtctcagagccattctcgttatgcctgatacaatgagtatggaacgacgcaatctgctgcgcgcatacggggcggagcttgtgctgactcccggcgcagaaggaatgaagggcgccattaaaaaggcggaagaacttgccgaggaacacggatactttgtgcctcagcaattcaacaatgcggcaaacccggaaattcaccgtcaaacgacggggaaagaaatcgtagaacagtttggtgacgaccagcttgatgcgttcgtggccggaatcggtaccggcggaaccatcacgggagcgggcgaagtgctgaaagaagcatatccatccatcaaaatctatgcggtagagccggcggattctccggttctttccggcggaaaaccgggcccgcataaaattcagggtatcggagcgggatttgttcctgaaacattgaatacggacatctatgatcaaatcattcccgtcaaaaacgaggatgcatttgaatatgcccgtaaaacggcaaaagaagaagggattctcggcggtatttcttccggagcggccatttacgcggcactggaaatcgcgaaaaaactcgggaaaggcaagaaagtgcttgcgatcatccctagtaacggagaacgttacttaagcacaccgctttatcagtttgaatagagacatacacacggctcccggctgtatccgggagtttttttgtgcctgaagtatcgaaaatccaaaaaacgtttcgaattttatggttggaagtgaaattcacttttttcaccagtgtgattgctttaaaataaaactacagtaaaacgaagcagaggattgatatgatggcacaacgcagaccggcaggaagaaaaataccttttacgaaacaagcatttttacagcgatatgaaaacctttcgaaatcgagaaaacggcatgttctgctcgaaagcgcgagagggggaagattcagtatagccggtctagatccgattgcgtccgtcagagggaaagacggaattacaacgatcaagcatgagggagaaacactgtttaaagaaggtgacccgctgcgggcctttcatgaatggtttggaacgctcggaacggaaacaaacgttgagtttccggactttcagggcggtgcgattggttttatcagttacgactatgcccgatatattgagaattttaagatgctgtcgttagatgatctggaaacacccgatatttactttcttgtttttgatgatgtggccgtttatgaccatgaggaagaggcgttatggctcattacccatactgaagcggaagaagcggatcttgcggaagaaaagctgtccggcttagaggacatgtggtgttccctccaaacggcggacgagcctttttcaccgctgaatcggaatggggacggatcgtacgccgctccgttcactgaggaaggattttcacaggctgtagaacaaattaaacaatatatcgcgagcggcgatgtgttccaggttaatttgtccatcaggcagtctcagtctttatccgttcatccgtatgaggtgtataaacacttgagaaacgtcaatccgtctccttacatggcctatctcgagacaccggggtttcaagtgatatgcgggtcgccggagctattggtgacaaagaaggggaagaagcttgaaacgagaccgatcgcgggtacgcgttcaagaggaaaagacgatgctgaagacaaggctttggctgatgaattaattcacaacgaaaaagaacgtgcggaacacgtcatgcttgttgatcttgagcgcaatgacctcgggcgcgtatcgcgctacggttccgtgcgggttaacgagtttatggcgatcgaaaagtattcccacgtcatgcatatcgtgtcaaacgtacagggagagctgcaggacggatatgacgcgacagacattattcatgcggtgttcccggggggcaccatcacgggagcgcccaaagtgagaacgatggaaattatagaagagcttgagccgacaagacgggggctttatactggatctataggctggttcggatttaacggagatttgcagtttaacattgtgatccggacgatctatgcagccggcggacatgcttttatgcagtccggagcaggagtggttattgattcggttccgaagcatgaatacaaggaatcgttcaaaaaagcttttgcgatgaaaaaggcgttagagctgagtgaagaagagacaaaaaatcagacgaggtgagcagagatgattttaatgattgacaattatgattcatttacgtacaacttggttcaatatttgggtgagctcggggaggaactgatcgtcagacggaatgacgagattacgattgagcagattgaagagctgggtccggacttcttaatgatttctcccgggccgtgcagtcctgatgaagcggggatcagcctcgaagccatcaaacattttgccggcagtattcctattttcggcgtatgtctcgggcatcagtcgattgcgcaagtattcggcggcgatgtcgtcagagcagagcggctcatgcacggcaaaacgtcagaagttatgcatgacggacagacgatttttaacggcctgcaaaatccgctggtcgccacccggtaccattcacttattgtcaaagcggacacgctgccggattgttttacggtatccgctcaaaccaaagaaggagaaattatggcaatccgccataatgagctgcctgttgaaggtgttcagttccatccggaatccatcatgacctccttcggcaaagagatgctcagaaactttatagagacacaccgcaaaaaggaagtatcggtgtgattatatatttgaatggtcaatatatagaggagaaagaagcggcgctttctccttttgaccatggttatctgtacgggatcggcgcgttcgagacgttcaggctttacagcggccggccgtttctgccggatgcgcatgtcgccaggctcaacagggcgcttcgggatctgcagattgcatatgaggtgaacgaacaggagctgcttgatatgcttcggagactgttgcacctcaatgacataaaggacggcagcgcgcgtgtccggcttaacatctcggcaggcgtcagcgataagggatttgccgcgcagacttatgaaaagccgaccgttctttgtttcgtcagccggctcaatccggaaactctgcctgttcaaaaagaaggcaggcttctctctgtccggagaaatacgcctgaaggacatttccggttaaaatcccatcactatttaaacaacatgtacgctaaacgggagatcgggaatgatcccaatcttgaagggattttcctgaccggagaaggagatgtcgcggaaggcattgtctccaacgtgttttggcgaaaaggagacaaggtctttacgccatctttggatacgggaattctcgatggggtaacaagacagtttgtcattgatgaattgaaacggcaggggacagaagtcaccgaaggccgattccgttttcaatcaatgcttgaagcggatgaagcatggttgacaaactccgtgcttgaaatcatcccgttttctaaaatagaggaagtgccgctgcccggaatgagcggaaaaacggtgcaattgctccgtaagcagtatcagcaggaaataaacaaaatgaatgtacaggaggaggaacaaaatggcgcagcaaacaattgaacagcctaaactgattcatacaaaaaaaggcgctctgtcctataaagagaagacgctcgttatggggatattaaatgtaacgccagactccttctctgacggcggcaaatacgacagtacggaaagggcgcttctgcatgcggcgaagatggctgaagaaggggcgcatatcatagatatcggcggcgaatcgacaaggcccggcgcatcactcgtttcggctgatgaggaaatgtcacgagtcatccccgtcatagaacggatcacaagcgagctggacattccgctttcaatcgatacgtacaaagcgtccgtggcagacgaagcggtcaaagcgggagcctctatccttaatgacatctggggggcgaaaggtgaccctgacatggcgtcagtagccgccgcacacggagttccgattatcttaatgcataatcgtatggaaagaaactataacgatcttattcctgatatgcttgcagacttgatggaaagcgtaaaaattgccgcagaagccggtgtcacagatgaaaatatgattctggatccggggatcggctttgcgaaaaactatgaggacaatctggctgtcatgaacaagctggaggtgttcagcgggttagggtatccgctgctcctggcgacatcgagaaaaaggttcatcggccgtgtgcttgaccttccccctgaagaacgtgccgagggaacgggagcgacagtatgccttggcgtccaaaaaggctgcgacattgtgagggtgcacgatgtcaaagagatcgcaagaatgactaagatgatggatgctatgctgaacaaaggaggcgcgcattatggataaagtatatgtggaaggtatggagttttacggatatcacggcgtgttcgaggaagaaaacaaactcggccagcgcttcaaagtagacctgactgccgaactggatttgagcaaagcgggaaaaacggatgacctttcttataccattaactatgcggaattgtacagtgtctgccgcggcatcgttgagggcgagcccgttaatttggtcgagactcttgcggaacggatcgcagacaccgtccttgagaaatttgagccggtgcagcaatgtacggtaaaggttgttaagcctgacccgccgattcccggccattataaatcagtagccatagaaatgacgagaaagaaatcatgaacaatacggcatatatcggcctcggttccaatatgggcgaccgtgaacattatttgcgccaggcagtggccatgctcagccggcatcatggcgtgacggtgtcaaaggtgtcctccatatatgaaacagatcccgtgggttatgaggatcaagatcagtttctcaatatggcggttgaagtgaaaacggcgttatctccttttgaacttcttgacgtaacgcagagcattgaagctgaattaggcagaacgagagagattcgctggggaccgcggacggcagaccttgacattttgctgtataatcgtgaaaatattgaaacagagcggctgattgttccgcatccgagaatgtatgagcgcttatttgtccttgcgccgttaaaagaaatatgtccgcaggcggatcatatcacgataagcgctgaaacaaaccaagaaggtgtaagagtatggaagcagaaatctggggtaggcgaattcgtgcattcagaaagctgaaaggttatactcaagaaggatttgcaaaagcattaggtatatcagtttctattgtcggtgaaattgaacgcggaaaccgattgccgtcagatgccatcattcaagatgcggcagatgttttaaatataagtgcggacgaattggccccgcctgaaaaatagacaaatgaaaggaggggaaaaatgtttaaaatcggtgatattcaattgaaaaaccgggttgtgcttgcccctatggccggtgtctgcaactcagcgttcagattgactgtaaaggaattcggagccggattagtatgcgctgaaatggtcagtgacaaagcgattctttacaacaacgcaagaacaatggggatgctttacattgatgaacgtgaaaaaccgctcagccttcagatttttggagggaaaaaggaaacccttgtggaagcggcgaagtttgtagatcaaaacacgactgctgatattattgatattaacatgggatgtcccgtaccaaagattacaaaatgtgatgcgggcgccaaatggcttctcgatcctgataagatttatgaaatggtatccgcagtagtagatgctgttgataagccggttacagtgaagatgagaatgggttgggatgaagatcacatttatgcggtgaaaaacgcccaagccgttgaacgtgccggcggaaaagccgttgcccttcacggccgcacaagagtgcaaatgtatgaaggcactgcgaactgggatatcattaaagaagtgaagcaatccgtctccattcccgtcatcggaaacggtgatgtcaaaacgcctcaggacgcgaaacgcatgcttgaggaaacaggagttgacggcgtcatgatcggccgggccgcactcggcaacccgtggatgatttaccgtacggtgcagtaccttgaaaccggtgagttaaaagacgagccgaaagtccgtgaaaaaatgtcggtatgcaaactgcacttagaccgcctgattaagttaaaaggcgaaaatgtggcagtcagagaaatgagaaaacacgctgcctggtatctgaaaggtgtcagaggcaatgcgaatgtacgcaatgaaattaaccaatgtgagacgcgtgaagaatttgtgcagcttttagatgcatttaccgccgaggcagaggcaaaagagcttcaagatgcaaaagtaggttaatatacaccctctattgctgctcactgccagcttaccgctggcagtttttctgctttttcgtgaaatcaaaatgtaacggagtgataccaatgagtcaagaagagcaaaatcatgaggaattgaacgaccagctgcaagtcagacgagataaaatgaaccaactgagagaaaacggcattgaccctttcggcgaacgtttcgagagaacgcatcaatctcaacagatcatagaagcctaccaggagctttctaaagaagaactggaagaaaaagcgatcgaagtgaccattgcaggccgtatgatgacaaagcgcggaaaagggaaagccggctttgcgcatctgcaggacttagaaggtcaaattcaaatttacgtaagaaaagacagtgtcggcgaagaacaatatgaaatctttaaatcttcagacctcggagacgttatcggcatcacggggaaagttttcaaaacaaacgtaggcgagctttctgtcaaagcgacatcttttgaactgctgacaaaagcactgcgtcctcttcctgataaatatcatgggttaaaagacgttgaacagcgttaccgccagcgctatctcgatcttatcgtaaaccctgacagcaaacaaacgtttatcacacgcagcaaaatcatccaagcgatgagaagatacttagatgaccatggatacttagaagttgaaacacctacgatgcacagcataccgggaggagcgtctgcacgcccgttcatcacgcaccataacgcgctcgacatgcctctttatatgcgtattgcgattgaactgcacctgaaacgcctgattgtcggcggattggaaaaagtctacgaaatcggccgcgtgttccgtaacgaaggtgtttctacacgccacaatcctgaattcacgatgatcgagctgtatgaagcgtacgccgattataaagatattatgagtcttacggaaaacctcgtagcacatattgcgcaggaagtgcttggaagcaccacaatccagtacggcgaagagcagattgatctgaaacctgagtggaaacgactccacatggtagatgcggtcaaagaagcgacaggcgtagatttctggaatgagatgactgttgaagaagcgcgcggtcatgcaaaagagcatggtatcgagatcacaaactcaatgacggtgggtcatatcatcaatgaattcttcgaacaaaaaattgaagaaacactcattcagcctacatttatttacggccaccctgtagagatttctcctcttgctaagaaaaatccggaggaccctcgctttacagaccgttttgagctgtttatcgtcggccgtgagcacgctaatgcgtttacggagctgaatgaccctattgaccagagggaacgctttgaagcgcagttaaaagaaagagaagaaggaaacgatgaagcgcatatgatggatgaagacttcgttgaagctcttgaatacggcatgccgccgaccgggggattgggtatcggtatcgaccgccttgtcatgctgttaacaaatgctccgtctatcagagacgttttattattccctcaaatgagacaacgctaataaaagggaaggcgccgtttctgcttatcgcagtccggcgcttttttagaaacaagccgctcgtaaaacttttttgattttcttttaaaaaactattgcactattatttgtgaggtggtatattattattcgttgccgctaaacaaggcgctgacgaaaaaggaaattcaaaaaaagttgttgacttcaagagattgataagatataataataaagtcgcttgaacgaaagacaaaatgatctttgaaaactaaacaagacaaaacgtacctgttaattcaaagttttaaataaatcgtacagcgatgtgcgtagtcagtcaaacactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagatcggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgcaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgtaagtgtaatatacggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcaccatttttggataagataataacacaagtcttttaaaaagagccattagctcagttggtagagcatctgacttttaatcagagggtcgaaggttcgagtccttcatggctcaccatgtaacgcgggtgtggcggaattggcagacgcgctagacttaggatctagtgtcttatgacgtgggggttcaagtcccttcacccgcattatacaggatagttatcctgtatgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattcattattatgcgcccgtagctcaattggatagagcgtttgactacggatcaaaaggttaggggttcgactcctctcgggcgcgccataatatttttaaaaatcgggaagtagctcagcttggtagagcacatggtttgggaccatggggtcgcaggttcgaatcctgtcttcccgaccacttcggggccttagctcagctgggagagcgcctgctttgcacgcaggaggtcagcggttcgatcccgctaggctccaccatttataaaaaacatgttgactttaagagaaacttattatataattaaaaagttgcttgagaaagtgaacgaaatgatctttgaaaactaaacaagacaaaacgtacctgttaattcaaagttttaaataaatcgcacagcaatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccatagaaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattctacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcatttcggtaaaggcagctcatcatgagctgccttttttgtgtttttctgcatacgttatataatatgagaaacgtaacgatatgcctttttgcaaaagcaggttttatgcttgtgcaaagtggaaataatagagatagagcgatacagttgaaaaattttgcgaaacaccttatagtaagattaaagtcaaatatagtcaaagtcaataaaggagggggttgagtgggacataatatttctgacatcattgaacagtacttgaaacaagtattagatcaaaatggcaaagaaattttagagatcaaacgcagtgaaatcgctgataaatttcaatgtgttccttcccaaataaattatgtcatcaacaccagatttacaagtgaaagaggatatattgttgaaagtaaacggggaggcggcggttatattcgtattatcaaaattaaaatgaataacgaagtcgtcctcatcaataatattatttcgcagatccatacccacttgtcccaggcagcctctgatgacattattctcagactgttagaggacggagttatttcggaaagagaagctaaaatgatggtgagtgtaatggatcgttcagttctatatattgatttgcccgaacgggatgaactaagagccagaatgatgaaagcaatgctcacatctttaaaactaaagtaagcgggtgaaaagattgatttgtcaagaatgcaatgagagaccggccacttttcactttacgaaagttgttaatggagaaaagcaagaagttcatatttgtgaacaatgtgcaaaagaaaatagcgattcatacagtataagtggaaaccaagggttctcgattcataatttattatcagggctgctgaatatggagtcctcatttcaaaacaccggttctcaaatgttcggctactcagagcaaggcacagcttgtaagaaatgcggtatgacgtttcagcagctgagaaaaacagggcgtttcggctgtgcggaatgttacgatacgttctacagccaaattacgccgatcttgcgaaaagttcacagcgggaatacggtgcatgccgggaaaattccaaaacgaataggcggaaacctgcatgtaagacggcaaatggaaatgttaaaaaaagaacttgaatctttaatacaccacgaggagtttgaaagagcagcggaggtcagggatcagatccgatcgttagagcaagaattaaaaagtacagacagtgagggggaacaagggtaatgtcgctcaagcattttattcaggacgcactaagcaattggatgaagcaaaagggacctgaaagtgacattgtactcagcagccgtatacggttggcccgaaactttgaaaatataaagtttcccgcccggtatacgaatgaagaagcctcatccatcattcagcaattcgaagatcatttttcaggtaaggaactgcctgatatcggtcaatttcatttaatcagaatgagtgaagctcagcctttggaaaaacgggtgctgatggagaaacatctgatcagcccgaatttaacggaatctccttttggcggctgtctgctttctgaaaatgaagaagtcagcattatgttaaatgaagaagatcatatcagaattcaatgcctcttccccggcttccagcttctcaacgccataaaagcggcaaaccaggttgatgactggattgaggagaaagtggattacgcctttggagagaagagagggtacttaacaagctgtcctacaaatgtagggacgggactaagggcttcagtcatgatgcatttgccgggtcttgtattaactaggcaaatgaatcgaattataccggcaattaaccaattaggcttagttgttagaggaatttacggtgaaggcagcgaagcattaggaaatatctttcaaatttcaaatcaaatcacactcggaaaatcagaacaggacattgtagatgatttaaacagtgtggctgcccagctgattgagcaggaacgttcagcccgagaagcgctttaccaaacttcgaaaattgaattggaggaccgggtattcagatcttacggcgttttatccaactgccgtatgattgaatcaaaggaaacggcgaaatgcctttctgacgttcggctggggatagacctggggatcattaaagggctatcaagcaatatacttaatgaactgatgattttgacacagccgggttttctccagcaatattcgggcggtgcattacggccgaacgaaagagacgcgagaagagcggcgcttatcagggaaaggctgcatttagaaatgagtgcaaatagacaggaggatgattcgatatgatgtttggaaggtttacagagcgagctcaaaaggtattggcactggcacaggaggaagcactgcgcttaggccataacaatattggaactgaacatatcttattaggtctggttcgtgaaggagaagggattgcggctaaagcactccaagcactcggactcggttcggataaaattcagaaagaagtggagagcttaatcggacggggacaggaaatgtctcaaacgattcattatacgccaagagcaaaaaaagtcattgagctcagcatggatgaagccagaaagctaggacattcttatgtgggaacagaacacatacttctcggattgattcgtgaaggagaaggcgtggcggcgagggttctgaataatctaggtgtcagcttgaataaagcgagacagcaagtgctgcagcttctgggaagcaatgagacgggatcttctgcatccggtaccaacagcaatgcaaacacgccgacgcttgacagtctggcgcgtgatttaactgcgattgcgaaggaagacagtcttgatccggttatcgggcgaagcaaagaaattcagcgtgttattgaggtattaagccgcagaacgaaaaataatcccgttcttatcggagaaccgggtgtaggtaaaactgcgattgctgaaggccttgcacagcagatcatcaataatgaagtgccggaaatattacgtgataaacgcgtaatgacattagacatgggtacggttgtagccggtacgaaataccgcggagaatttgaagaccgcttgaaaaaagtaatggatgaaatacgtcaggccggcaatattattttattcattgacgaactgcatacactgatcggagcagggggagcagaaggtgcgattgacgcatcgaatatcttaaaaccttcactggcccgcggagagcttcaatgcatcggtgccacaacgcttgatgaataccgtaaatatatcgaaaaagacgcggctctcgagcgccgtttccagccgattcaggtggatcagccgtcagccgatgaaagcattcaaattttaaaagggctccgtgaccggtatgaagcccatcaccgcgtatccattaccgatgaagcgatcgaagcggcggttaaattgtccgaccgttatatttctgaccgcttccttccggataaagcgatcgatttaattgatgaagccggttcaaaagtgcgtctccgttctttcacaacgcctccgaacttaaaagagcttgagcagaaactcgatgaagttcgcaaggaaaaagacgctgccgttcagagccaggagtttgaaaaagcggcttctcttcgtgatacggagcagcgcctgagagaacaggtggaagacacgaaaaaaacgtggaaagaaaaacaaggccaggagaattccgaagtttctgtagaggatatcgcgatggttgtatccagctggaccggggtgcccgtatctaaaattgcccaaacggaaacagataagcttctcaatatggaaagcattctgcattcccgcgtcatcggccaggatgaagccgttgtagccgttgcaaaagctgtcagacgtgcaagagccggactgaaggacccgaaacgtccgattggttcattcatcttcttaggccctacaggcgttgggaagacagagctggcaagagcgctggcggaatccattttcggtgatgaggaagcgatgatcagagtggatatgtccgaatacatggagaaacactcgacttcacgccttgtcggttctcctcccggatatgtcggctatgatgaaggcggccagctgacagaaaaagtgagaagaaaaccttactctgtcgtattgcttgatgaaattgaaaaagcgcaccctgatgtgtttaacattctcctgcaagtgcttgaagacggacgcttgactgattcaaaaggacgcactgtggatttccgcaacacgatcctgattatgacgtcaaacgtcggggcgagcgagctgaagcgcaacaaatatgtgggcttcaatgtccaggatgaatcacaaaaccataaagatatgaaagacaaagtcatgggagagctgaagcgtgccttcagacctgagtttatcaaccggattgacgaaattatcgtcttccactcccttgagaaaaaacatcttacagacatcgtgtcgcttatgtctgatcagttaacaaaacgtctgaaagaacaagatctttctatcgagctgacggatgctgcaaaagcaaaagtagcagaagagggcgtcgatttggaatacggcgcacgtccgttaagaagagcgattcaaaagcatgtggaggaccggttatcagaagaactcctcagaggcaatattgataaaggccagcacattgttcttgatgttgaggacggcgaatttgtcgtaaaaacaactgctaaaacgaactaatatagtgacaaacatgaggcatacgtaagcgagtgtatgcctcactttgttatatagagaaatatttgataaggaagaggtcttacaacatatatggctaaatcaaaaacaaaattcatctgccactcatgcggttatgaatccgcaaaatggatgggaaagtgcccgggctgcggggcttggaatacaatggtggaagaaaccataaaaaaagcgccggcgaatcggcgggcggctttctcccactccgttcaaaccgtccagaaaccatcacccattacatcaattgaaacatcagaagaaccccgcgttcacacaaagctcgaagaattcaacagagtgcttggcggcggcgttgtgaaaggctcgttagtattgatcggcggcgatcccgggatcggaaaatcaacgctccttctccaagtatccgcacaattagcagatacggccggcagcgtgctttacatttcaggggaggaatccgtgaagcaaacgaagctgcgcgccgacagacttggaatcaacagccaaatgttacatgttttatctgaaaccgatatggagtatatttcgtctgctatacaagagatgaaacccgcatttgttgtcgtagactccattcagaccgtttaccaaagtgatatcacctcggctcccggcagtgtatcacaagtaagagagtgtacggccgaattgatgaaaatcgcgaaaacaaacggcatacctatttttatcgtcggacacgtcacaaaagaaggatcgatcgcagggccgagattgcttgagcacatggtcgataccgttctatactttgaaggagagcggcaccatacattccgtattttgcgggctgtaaaaaaccggttcggctcaacaaatgaaatgggcatctttgaaatgcgggaagaggggcttacggaagtgctcaacccttctgaaattttcttggaagagcgttctgccggggcatcgggttcgagtatcgttgcatcaatggaaggaacgagaccgattctggttgaaatccaggcgctcatatcaccgaccagttttggaaacccgcgccgcatggctacaggcattgaccacaacagggtatcgttaattatggctgtgcttgagaagcgggtgggtcttttgcttcaaaatcaagatgcatatttaaaagtcgccggcggggtcaaactggatgaaccggcgattgatttggcagtagccgtcagcattgcctcaagcttcagagatacaccgccgaatcccgcagattgctttatcggtgaagtgggactgacaggagaagtccgcagggtgtcaagaatcgaacagcgcgtaaaagaagcggcgaaactcggcttcaagcgcatgatcatacctgaggcgaatgcagacgggtggacaataccaaaagggattgaggttgtcggagtagcaaatgttgctgaagcgcttcgtacttcattaggaggatcataatagatggaaaaagagaaaaaaggggcgaaacaagagcttgacctgtctgcaattctgcagttcgttgcaccgggcaccccgctcagagccgggatagagaatgtacttcgggcaaatacaggcggcctgattgttgtcggatacaatgataaggtaaagcaagtcgtggatggcggttttcatattaatacatcatttgcgcccgctcacttatacgagctggccaaaatggacggtgccattattttaagtgattccggccagaaaattctttatgcgaatacgcagcttatgccggaggcgaccatttcttcttcagaaacgggaatgaggcaccgtacggcggaacgggtggcgaagcagaccggctgtctcgtcatcgccatttctgagcgcagaaatgtcattacgttatatcaggacagcatgaagtacacactaaaggacataggttttattttaacaaaggcaaatcaggccattcaaacgctagagaagtataaaaccattttagacaaaacgattacggctttaaacgcattagagtttgaggagcttgtgacattcagtgacgtgctgtctgtcatgcatcggtatgaaatggtgcttcgaataaaaaatgaaatcaatatgtatattaaagaactcggaacggaaggacacttaatccgtctgcaggtgattgaactgattacggacatggaagaagaggcggcacttttcatcaaagactatgtcaaagaaaaaatcaaagatccgttcgtgctgttaaaagagcttcaggatatgtccagctatgatctgcttgatgattccattctgtttaaactgcttggatatccggcttctacgaatcttgatgattatgtgctcccgagaggatacaggctgctgaacaaaattccgcgtctgccgatgccgattgttgaaaatgtggttgaggcgttcggatttttgccaagcataacggaagccactgtagaagagcttgatgatgtcgagggtatcggcgaagtgcgcgcccaaaaaatcaaaaaaggcttaaaacgccttcaggaaaaacactatatagatagacagctttaagtatcgcttaaacctgtcggaatccgggtatattattgttagtttttgtttattctgaatttgtaggctctgacagtctgctgaaaaaatgctacttaaaaggaggtggaggtatgttaaaacgaatagttcaggcgttcttcattattgtgggcggcgttgtcggtatctttttaatacctgaattgtttgtgctgtcaaatatacaggacatacctttaataacaaacgcatatacgtctgctgcaattggtgctattatcttttttctcatcagtatatggacgacagaatatgtgattaattgggtaaaatggattgaagattctttgctgagagctccggtgccggatctgttattcgggagtctcggattggtttttggacttatcatcgcatatctcattgtaaacgtgattccgctggacaatattccgtaccgtatattcagcaccatcattccggtctttctggctttctttctcggttatctgggcttccaagtcggatttaagaaaaaggatgaactgatcagtcttttctccatttctgcaagaatgcagaagaaaaagggaagtgctgatgaggagcaggaagaacaggataaaaggctgaaaatcttggatacaagtgttattattgatgggagaattgcagatatttgtcagacgggctttttagaaggcgtcattgtcattcctcaatttgtgctggaggaattacagcatatcgctgattcttcagatgttttaaaacgtaacagaggacgccgcggactggatatcttgaatcgcattcaaaaggaactggatattacggttgaaatttatgaaggcgacttcgaagacattcaggaggttgacagcaagcttgtcaaacttgcgaagctgacttccggcgtcgttgtgacgaatgattttaatttaaataaagtatgcgagcttcaaaaggttgcagtactgaatattaatgaccttgcaaacgcggtgaagccggttgtgcttccgggcgaagagatgaatgtgcaggtgattaaggacgggaaagagcataatcaaggtgtggcttacttggatgacggcacgatgattgttgtggaagaaggccgcaattatatagggaaacatattgatgtgctcgtaaccagcgtactgcagacagcggcgggacgaatgatttttgccaagcccaagctgcttgagaaagctctttaagagggagttcatatggagtatgttgtcgttattccggctgccggacaaggaaaaaggatgaaggccgggaaaaataagctgttcatcagcttaaaaggtgcgcctgttattatacacacactgcgggtttttgaaagccacgcaccctgtcagaaaataatcctggtgataaacgagagtgaacgggaagattttcgccagctgctggcccaatgtccgattcagacggaaattgagcttgttaccggaggtgcggagcgtcagcacagtgtatacgaaggactgaaagtgattgataaggaatcggtcgtccttgttcatgacggagcgcgcccgtttgtcacacatcagcatatcgataagctcgttgaaacagcagagaaggcaggagcggctgtcctggctgttcctgtgaaagacacgataaaacgggcggaaggctcccgggttgcggagacctttgaccgttcaagcttgtgggccgttcaaacgccgcaagcttttcgtctttctttattgaagacggcgcatatggaagcggaaaacaaaggcttcttaggtacggatgacgccagcctcgtcgagcgtcttgatggatatcaggtgagtatcgttgaaggcagctataccaatattaagctgacaacgccggatgacctgatatttgcggaagcaatcatgaaagcggaaagtgggaatcataatgtttagaatcggacaaggatttgatgtgcatcaattaacggaaggccgtccgctcatcatcggcggaattgaaattccttatgaaaaggggctgctcggacattcagatgctgatgtattgctgcatacagtcgcagacgcgtgtctcggagcggcaggtgaaggagatatcggcaaacatttcccggatactgatccggaattcaaggatgcggattcttttaagctgcttcagcatgtctggaacattgtaaaagaaaaagggtacgtactcggaaatatagactgcacgattattgcgcaaaagccgaaaatggcgccgcatattgatgctatgagaaaacggatagctgaaggccttgaggcggacgtctctcaagtaaacgtaaaagcgacgacgaccgaaaagctcgggtttaccggaagagccgaaggaattgccgctcaggcaaccgttctgatccaaaaagcctgatcattgttttgatgccgggtctatttggtggtagaatagatacatatattcggctagaggctacagacgagatgaaaggaagtatttgaacatgggaaatgaagtacgcgttcgttatgcaccgagtccgaccggacatttgcatatcggtaacgccagaacggcgctttttaactatttatttgcccgcagccaaggcggaaagtttattatccggattgaggatacggacaaaaagcgaaatattgaaggcggagagcaaagccagctcaactatttgaaatggctcggcatggactgggatgaaagtgtggatgtcggcggagaatacggcccgtaccgccagtctgagcgtaacgacatttacaaagagtactatgaagagcttcttgaaaaagggcttgcttataaatgtttctgtacggaagaagaacttgagaaagaacgtgaagagcaaatcgcccgcggggaaatgccgcgctattccggcaaacacagaaacctgactcaggaagagcaggagcagtttttagccgaaggcagacagccgagcatccgtttccgcgtgccggaagggaaaatcatcgcatttaacgatatcgtaaaaggcgagatttcttttgaatcagacggcatcggcgactttgtcatcgtcaaaaaagacggaacaccgacgtataactttgctgtcgcgattgacgattacttaatgaaaatgacgcacgtgctccgcggtgaggatcacatttcaaatacaccgaaacagatcatgattttccaggcattcggctgggatattcctgtcttcggacatatgacgcttatcgtaaacgaaagccgcaaaaaattaagtaaacgtgatgaatcaattatccagtttattgagcagtatgatgagctgggttacctgcctgaagcgctgtttaactttatcggacttctcggctggtctcccgtcggtgaagaagagcttttcacaagagaacaattcattgaaatttttgatgtaaatcgtttgtctaagtcaccggctctgtttgatatgcataaactgaaatgggtcaacaaccaatacgttaaagcgctggatcttgatcaagtggttgagctgaccctgccgcacctgcaaaaagcaggaaaagtcggcactgagctttctgccgaagaacaggaatgggttcgtaaattaatctctctttaccatgagcaattgagctacggcgctgaaattgtcgagctgactgatttgttctttaaagatgagatcgagtataatcaagaggcaaaagccgttctggaagaagaacaggtgcctgaagtgctcagcgtatttgctgcgaagcttgaagagcttgaagaatttacgcctgagctgatcaaagcctcaatcaaagctgttcagaaagaaacaggccataaaggcaaaaagctgttcatgccgattcgtgtagcggttaccggtcagacacacggtccggagcttccgcaggccattgagctgatcggcagagaaacagccgtcagacgcctgaaaagcatttaaatatacgattgttgacagggaagagtataaaacaatgaccattacagaaagaatcttcgtcggctgagagagattcatgcgtcatgttttagaagtgcgcccttaagacctttgaagaacatttctgcggaaatcagtatttaaaggcggccgccgccgttaccggcttttaagttgggaaaacagtgacttgtttttcaaacagagtggaaccgcgcggtaaaagcgtctctgtcatgtttacatgcagaggcgctttttttataggcggaaaaacagactggagcggggagagaatggggggaagcatgtgttttttaaaatgctaaaagaagacatagatacagtgttcgatcaagatccggcagcaagaagctatttcgaagttgttttaacttattctggtttacatgctatatgggcgcatcggattgcacatgctttatataaacggagatttttcttcctggcgcgcctgatatcacagattgcccgtttctttaccggaattgaaatccatcccggcgcgaccatcgggagaaggtttttcattgatcacggtatgggggtcgtcataggggaaacatgtgaaatcggcaataacgtgacggtattccaaggtgtcactcttggtgggacgggaaaagaaaagggaaagcggcatccgaccataaaagatgatgctttaattgcaaccggagcgaaggtgctcggctctattacggtcgggcagggctctaaagtaggggccggctccgttgtgcttcgtgatgttcccgacttttcgaccgttgtcggcataccggggaaagtcgtcattcagaacggaagaaaaatcaaacgcgatctcaatcaccaagacttgcccgatccggttgctgaccggtttagagcattggagcagcagatttttgaactgcaggctgaactggaagataaaaaagaaaggatcaaccaaaaatgaccattacactttataatacattgacacggaaaaaagaaacattcgttcctcttgaggaaggcaaagtaaaaatgtacgtgtgcggaccgactgtatacaactatattcatatcggaaacgcccgtccggcgattgtgtatgataccgtacgcaactatttggagtataaaggatacgatgttcaatacgtatcgaatttcaccgatgttgacgacaaactgattaaggcggccaacgagctcggcgaggacgtcccgaccgtttctgaacggttcattaaagcgtattttgaagacgtgggcgccctcggatgccggaaagcggatcttcacccccgggtcatggaaaacatggacgccattattgaatttgtcagcgagctgattaaaaaaggttacgcttatgaatcagaaggcgacgtctatttcaaaacaagggccttcgaaggctacggcaagctatctcagcaatccattgatgaactcagatcaggcgcgcgtatccgtgtcggcgagaagaaagaggatgcgctggactttgcgctttggaaagctgctaaggacggagaaatttcatgggatagcccttggggaaaaggccgcccgggctggcatattgaatgctccgcaatggtgaaaaagtatttgggtgacgaaatcgatattcacgccggcggtcaggacctgacattcccgcaccatgaaaacgaaatcgcgcaatctgaagcattaacaggcaagacattcgcaaaatactggcttcataacggatatatcaatatcgataatgagaaaatgtcaaaatcgctcggcaactttgttttggtgcacgatatcattaagcaatatgacccgcagcttttgagatttttcatgctgtccgttcattaccgccacccgatcaactattcggaagagctgcttgagaaaacaaaaaacgcgtttaaccgcctgaagacggcatacagtaatttaaaccatcgtttgattagcagcacgaatctgactgacaatgatattgaatggctcgctaaaatcgaagagcaccgcgctgcatttgaagaagcgatggatgatgattttaatacggcgaatgcgatttccgtttggtttgatttggcgaagcttgccaactactacatgcaggaggacaatacggcggatcacgtcattaaagcctttatcagcatgtttgacagaatcggatccgttctcggacttacactcggcgaagaagagcttgtcgatgaagagattgaagaattgatcgagaagagaaatgaagcccgccgcaatcgcgattttgctttgtcagaccaaattcgcgatcagctgaaaagcatgaatatcattcttgaagatacggcccagggaactcgctggaagcggggagaataagcggatgcttcaatttgaacaaatcaaagattcaaagcagttaaacggtcttgcgctcgcttatatgggtgatgccatttttgaaatatacgtccggcatcacctgcttaagcagggctttacgaaaccgaatgaccttcataagaaggcgagccggattgtatcggcaaaatcacaggcagacatattgttccgccttcaggacgaatcctttttcacggaggaagaggaagccgtgctgagaagaggcagaaacgcgaaatcagggacgacgcctaaaaacacagatgtacagacgtaccgccatagtacagcttttgaggctttactcggatacctttttcttgagaaaagagaagaaagactgaatcagctgattgctgaggctatacaagtcgggacgtcagggaggaaaacaaatgagtcagcaacatgattacgtcataggaaaaaacgctgtgattgagacgttaaagtcagatcgcaagctgtataagttatggatggcggaaaacacagtaaaaggacaggcgcagcaagttatggagcttgctaaaaagcgcggcgtcaccattcaatttgtaccgaggaaaaaacttgatcagatggtggaggggcagcatcagggtgttgtcgcccaggtggcggcatatgaatatgcacaattagacgaattatataaaagagcggaagagagaaacgaacagcctttctttctcatattggacgagctggaagaccctcataatctcggttccatcatgagaacggctgacgctgtcggtgcacacggcattgtgattccgaaacgcagagcggtcggactgacgtcgacggtcgcaaaagcttcgaccggtgcgattgaacacattcccgtcgtgaaggtgaccaaccttgcccggacacttgatgaaatgaaggagcgggggatttgggtcgtcggaacggatgcatccgcccgggaagactaccgctctatggacggcaagatgcctttggcgctcgttatcggaagcgaaggcagaggaatgggccggcttgtgaaagagaaatgtgattttctcattaaacttccgatggccggaaaagtcacgtctctgaatgcgtcggtagcggccggccttctcatgtatgaagtctaccggaagcgcaatcctttaggggaatgaagacagatggacatcctgttagtagacggatacaacatgattggagcttggccgcagctaaaggatttaaaagcgaacagttttgaagaagcgagagatgtactgatccagaagatggcggaatatcagtcctacacgggaatcagagtcattgtggtgtttgacgcacatctggtaaaaggcatagagaaaaaacaaacgaatcacagagtcgaagtgatttttacacgggagaatgagacggcggatgagcggatcgagaagcttgcccaggcgctgaataatattgcgacacagattcatgtcgcaacctccgattatacggagcagtgggcgattttcggacaaggggctctccgcaaatccgcccgggagcttctgagggaagtggatacgatagaacggcggattcaaaggcgggtttcaaagatcacttctgaaaaaccaccggggaaaatcgagctgtccgaagaggttttgaaaacgtttgaaaagtggcgccgaggcggtctggattaggttgacgctttttcgcccattaatgtataatatttctatctacgtgcgccggggggatcgcagtgaatctacagaacagcaagggaaagttcaacaaagtgcaattttgccagttggaggacgagcaggtcattgaaaaggttcatgttggggatagtgatgcgttagattacttgattacgaagtaccgtaattttgtacgggcgaaagcaaggtcttattttttaataggggccgacagagaagatattgtacaggaagggatgataggcttatataagtctatccgagactttagagaggacaagcttacttcatttaaagcttttgcagaattatgcattacccgccagattattaccgcaataaagacagctacccgtcagaaacacattcctttaaattcctatgtttctttagacaaacctatttttgatgaagaatccgacagaacactgcttgatgtcatttcaggcgctaaaacgttaaatcctgaagagatgattattaatcaggaagaatttgatgatatcgaaatgaaaatgggagaactgctgagcgatctggagagaaaggtgcttgttctgtacttggacggaagaagttaccaggaaatttcagatgacttaaaccgacacgtaaaatcaatcgataatgccctgcagcgcgtgaagcgcaagcttgaaaagtatttggaaataagagaaatcagtctgtagcaggtttctgtgtcatattgacagaatttttctgactgtgctattttattaagataaatgattgtttaggaaaaggtgtaacgatatgagaaaaaagattacgctggcatgcaaaacatgcggaaatcgtaattatacgacaatgaaaagctctgcatcagcggctgagcggttagaagttaagaagtactgcagcacttgcaattcacatacagctcatttagaaacaaaatagtgttcgctttttaaattgtggaggtcttttacatgcgcatgatgagtttctttaaagatgttgggaaagaaatgaaaaaggttagctggcctaaaggcaaagagttaacgcgctatacgatcacggtgatttcaacggttatcttttttgttatcttttttgccctccttgatacaggaatttctcaattaattcgtttaatagttgaataatgatcagcaatacgtgctataatagatcataatatcgtttgccaaaacccgttcagcgggttttttattgtgttgaaaaaaggattcataggctctgagcctattttttgttttacacttcatttttaaatgcggggagggaaggactgcagagtcctgatagaatggaaaagaattggtatgttgttcatacgtattccggttatgaaaacaaagtaaaagcgaaccttgaaaaacgtgtggaatcaatgggaatgcaggataaaattttccgcgttgtcgtccctgaagaggaagagactgatattaagaacggcaagaaaaaagtagtcaaaaagaaagtgttcccgggttatgtgcttgttgaaatcgtcatgactgatgattcctggtatgtggtccgcaacacgccgggcgttaccggattcgtcggatcagccggttcaggctcaaagccgactccgcttcttcctggcgaagcggaaaccatcttaaaacgcatgggcatggatgagcggaaaaccgacattgattttgaattgaatgagacagtcaaagtcatagacggacctttcgccaactttacaggatcaattgaagagattgattatgataagagcaaagtgaaagtattcgttaacatgttcggccgtgaaacgccggttgagctggaatttacccagatcgacaaattgtaatgtgaaaaaacttgaaattgctatatattaatgataatatagcaaaggtacgtcttggactaatccaaggcagctagcttgatatttcgtcattcatataaagaatgaaaccttgagtgggagggtttaccctattaccacatcacggacttaaggaggtgtgtctcgtggctaaaaaagtagtaaaagttgtaaaattgcaaattcctgctggaaaagctaacccagcgccgccagttggacctgcactaggtcaagccggtgtaaatatcatgggattctgtaaggagtttaacgctcgtacagctgaccaagctggtttaatcattcctgttgaaatttcggtttacgaagaccgttcatttacatttattacaaaaactccgcctgctgcagtattgcttaaaaaagcagctggaattgagtctggttctggtgaaccaaaccgtaataaagtggcaaccgttaagcgcgataaggttcgcgaaatcgctgaaacgaaaatgcctgacttaaacgcagcagacgttgaagcggcaatgcgcatggttgaaggtactgcccgcagtatgggtatcgttatcgaggattaatttgtttcttgtcgggttgcgagttttcacaagttcgcaacccttattcgtgggaggttattccgctataaccacataaggaggaaattttaaaatggctaaaaaaggtaaaaagtacgttgaagctgcgaagcttgtagaccgtgcgaaagcttacgacgtcgctgaagcagtggcgcttactaaaaaaacaaacacagctaaattcgacgctacagttgaagttgcttttcgtttaggggttgaccctcgtaaaaacgatcagcaaatccgcggtgcagttgtacttcctaacggaactggtaaaactcagcgcgtgcttgtattcgctaaaggcgaaaaagcaaaagaagctgaagctgccggtgcagactacgtcggcgattctgattacatcgcgaaaatccagcaaggctggttcgaattcgatgtaatcgttgcgactcctgacatgatgggtgaagtcggtaaaatcggccgtgtgcttggaccaaaaggtcttatgccaaaccctaaaacaggaactgttacattcgaagtagaaaaagcaatcggcgaaatcaaagctggtaaagtagaataccgcgttgacaaagctggtaacatccatgttccgatcggaaaagtttctttcgaggatgaaaaacttgttgagaacttcacaacaatgtatgatacaatcctgaaagcaaaaccggctgcggctaaaggtgtttacgtgaaaaacgttgccgttacttctactatgggccctggtgtcaaagtagacgcttctactttcaacgtaaaataatatttgactttagatcagcattctgatatgattcaaaatgttgtaaaatataatatgtcatttataccgtagacagcaggggccgttgaggcttaatatcctgccgaggtgtatatatatcacagctattacgttacgtatgcttgtatatacagcctccatgtccacatggaggctttttatatgaaatcgtcgtcacagtcgtgatcacctagcggtataagtgttacacaaaatctacaggaggtgtaaccatgagcagcgcaattgatacaaaaaaagttgttgttgaagagattgcttctaaactgaaagaaagcaaatcaacgatcatcgttgactaccgcggacttaacgtttctgaagtaactgaactccgtaaacagcttcgcgaagctaacgtagagttcaaagtgtacaaaaacacaatgactcgccgtgcggttgaacaagctgaacttgatggtttgaatgatgtcttaactggaccgaatgcgatcgcattcagtactgaagatgttgtcgctccggcaaaagttcttaacgagttcgcgaaaaatcacgaagctctggaaatcaaagcgggcgttatcgaaggaaaagtatcttctgttgaagaagtgaaagctcttgctgaacttccttcacgcgatggcttactttctatgttgcttagcgtacttcaagctccagttcgcaaccttgcacttgcagctaaagcagttgcagaccaaaaggaagaacaaggcgcttaatctgattttaccctaaaataaaacaaatggaggaatttcaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggcgctgctgaagagcaaagcgaattcgaccttatccttgctggtgcaggttctcagaaaatcaaagttatcaaagttgttcgtgaaatcactggtcttggcttgaaagaagctaaagaacttgttgacaacactccaaaaccacttaaagaaggtattgcgaaagaagaagctgaagagcttaaagctaaacttgaagaagttggcgcttctgtagaagttaagtaatcttcacttgcctgtaggggaagctcgcttttatgaggcgggctttttctttgcttttctttaagtgcaattaaaaaaggaggttctaataatgagtgaacactattattcagaaaaaccttcagttaaaagtgataaacagacatggtcatttacactgcggaacagatcttatacattcacaagtgacagcggcgttttctcgaaaaaggaagttgatttcggttcgcgtgtcttaattgaagcgtttgaagagccggagatcgatggtgacttcctggatgcaggctgcggttacggcccgatcggtctgtcgctcgccggtgcatttacagaccggaccgtgcacatgattgacgtgaatgaaagagccgtagagctgtcaaatgaaaatgcagaaaaaaacggaataaaaaacgttcggatttatcagagtgatttattttcaaatattgattctgctcaaacatttgcttctattattacaaaccccccaatccgcgccggaaaaaaagttgtccatgccatttttgaaaaaagcgctgagcatttaagggcttcaggtgaattgtggatcgttatacagaaaaaacagggcgggccttctgccattgaaaaactgaaggagctttttgacgaagtttctgtggttcaaaaaaagaaaggctattatatcataaaagcaaaaaaagtttgacttgaattttcagctatgttaatattgtaaaatgccaatgtatatattttgcatgatatgctcaaataatcatagtgcatgtataaattatacaaacatggaaatgctaataaaatcggtatttgtttttggatgtggttttcttaattagaaacccttttttcttttgtcttgtaaaagtatttctttatcgtaagagatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctctagagttcattgactacagtttaggagatcctaagtatcccgttgaagagtcaaaagaacgtgatgtgacttactcagctccgctaagagtgaaggttcgtttaattaacaaagaaactggagaggtaaaagaccaggatgtcttcatgggtgatttccctattatgacagataccggtacttttatcatcaacggtgcagaacgtgttatcgtatctcagcttgttcggtctccaagtgtatatttcagtggtaaagtagacaaaaacggtaaaaaaggttttaccgcgactgtcattccaaaccgtggcgcatggttagaatacgaaactgatgcgaaagatgttgtgtatgtccgcattgatcgcacacgtaagttgccggttacggttcttttgcgtgctctcggcttcggttccgaccaagagattctcgatctcattggtgagaacgaatatctccgcaatacactggataaggacaacaccgaaaacagtgacaaagcgcttcttgaaatctatgagcgccttcgtcccggagagccgcctacagtagaaaacgcaaaaagcttgctggattcccgtttcttcgatccgaagcgatacgaccttgcgaatgtaggacgctataaaattaataaaaagcttcatatcaagaaccgcctgtttaaccagcgccttgcagaaacactggtggatccggaaaccggtgaaattctcgctgaaaaagggcagattcttgacagaagaacacttgataaagtactgccatacttagaaaatggaatcggcttcagaaagctttatcctaacggcggcgttgtcgaggatgaagtgatgcttcaatccattaaaatctatgctcctactgatgcagaaggagagcagacgatcaatgtgatcggcaatgcttacatcgaagaggcgattaaaaacattacgcctgctgatattatttcttctatcagctacttcttcaacctcctgcacggagtgggcgacactgatgatatcgaccatctcggaaaccgccgtctgcgttctgtaggtgagctcctgcaaaaccaattccgtatcggtttaagccggatggaacgtgtcgtacgtgaaagaatgtctattcaagacacgaatacaattacgccgcagcagctgattaacatcagacctgttattgcgtctattaaagagttcttcggaagctcacagctttctcaattcatggatcagacgaacccgcttgctgaattgacgcacaaacgccgtctgtcagctctcggaccgggcggtttgacacgtgagcgcgcaggtatggaagtacgtgacgttcactactctcactacggccgtatgtgtccgattgaaacgcctgagggccctaacatcggtttgatcaactcattgtcatcatttgcgaaagtaaaccgctttggtttcattgagacgccataccgccgcgttgatcctgaaacaggaaaagtaacgcctagaatcgactacctgactgctgatgaagaggataactatgtcgtagcccaagcgaatgctaagctgagcgatgacggttctttcttggatgacagcatcgtagcgcgtttcagaggggaaaacaccgttgtagcccgcaaccgcgtggattacatggacgtatctcctaaacaggttgtatctgctgcgacagcatgtattccgttcttggaaaacgatgactcgaaccgcgccctcatgggagcgaacatgcagcgtcaggctgtgcctttgatgcagccggaagctccgatcgtcggaacgggtatggaatacgtatccggtaaagactccggtgcagccgttatttgtaaacaccctggtatcgtagaacgggtggaagcgaaaaacgtatgggtgcgccgctatgaagaaattgacggtcaaaaagtaaaaggcaacctggataagtacagcttgctgaaattcgtccgctccaaccaaggtacgtgctacaaccagcgtccgatcgtcagtgtcggcgatgaagtagtaaaaggagaaatccttgctgacggaccttcaatggagcttggtgaacttgctctcggccgcaacgtaatggtcggcttcatgacatgggacggttacaactatgaggatgccatcatcatgagtgaacgccttgtgaaagatgatgtatacacatctattcacattgaagaatatgaatcagaagcacgtgatacaaagcttggaccggaagagatcacccgcgatattccaaacgtaggggaagacgcgcttcgcaaccttgatgaccgcggaattatccgtatcggtgcggaagtcaacgacggagaccttctcgtaggtaaagtaacgcctaaaggtgtaactgagcttacggctgaagaacgccttcttcatgcgatctttggagaaaaagcgcgtgaggtccgtgatacttctctccgtgtgcctcacggcggcggcggaattatccacgacgtaaaagtcttcaaccgtgaagacggcgacgaacttcctccgggagtgaaccagcttgtacgcgtatatatcgttcagaaacgtaagatttctgaaggtgataaaatggccggacgtcacggaaacaaaggggttatctcgaagattcttcctgaagaagatatgccttaccttcctgacggcacgccgatcgatatcatgcttaacccgctgggtgtaccatcacgtatgaatatcggtcaggtattagaacttcacatgggtatggctgcccgctacctcggcattcacatcgcgtcacctgtatttgacggcgcgcgtgaagaagatgtgtgggaaacacttgaagaagcaggcatgtcaagagacgctaaaacagttctttatgacggccgtacgggagaaccgttcgacaaccgtgtatcagtcggaatcatgtacatgatcaaactggcgcacatggttgatgataaacttcatgcccgttctacaggtccttactcacttgttacgcagcagcctctcggcggtaaagcccaattcggcggacagcgtttcggtgagatggaggtttgggcgcttgaagcttacggcgcagcttacacgcttcaagaaatcctgactgtgaagtccgatgacgtggtcggacgtgtgaaaacatatgaagccatcgtcaaaggcgacaatgttccagagcctggtgttccggaatcattcaaagtattgatcaaagagcttcaaagcttaggtatggacgtaaaaatcctctcaggcgatgaagaagaaatagaaatgagagatctagaagacgaggaagatgcgaaacaggctgacggccttgcattatcaggtgatgaagcgccggaagaaacagcatctccagacgttgaacgtgacgcagtaacgaaagaatagtctctgattgataaaggcaagtgacatcggttaatccgaagataaaaagggaggtaggccccttgctagatgtgaacaattttgagtatatgaacatcggtcttgcttcaccggataaaatccgttcatggtcttttggtgaagtgaaaaagcctgaaacgataaactatcgtacgttgaaacctgaaaaggacggcctgttctgcgaacgcattttcggaccgactaaggactgggaatgtcattgcggcaagtacaagcgggttcgttataaaggcgtagtttgtgaccgttgcggagttgaagtaacgcgggctaaagtccgtcgtgagagaatggggcatattgaactggctgccccggtttctcacatttggtatttcaaaggtattccgagccgtatgggtcttgtattggatatgtcaccgcgtgcgctggaagaagttatttactttgcttcttacgtcgtaactgacccggccaatacaccgctcgaaaagaaacagcttttatctgaaaaggaataccgtgcgtatctggataagtacggaaacaaattccaagcctctatgggtgcggaagccattaataaacttctgcaggacatcgaccttgtcaaagaagttgatatgttaaaagaagagctgaagacttctcaaggacagcgccgtacacgtgcgatcaaacgccttgaagtgcttgaagccttccgtaattcaggaaacaagccgtcttggatgatcctcgacgtgcttccggttattccgcctgaattaagaccgatggttcagcttgacggcggacgtttcgcaacgtctgacctgaacgacctttaccgtcgtgtcatcaaccgtaataaccgtttaaaacgtctgttagacctcggcgcgccaagcatcatcgttcagaacgaaaaacgtatgcttcaggaagcagtcgacgctctgattgacaacggacgccgcggccgtccggttaccggaccgggtaaccgtccgcttaaatctctttctcatatgctgaaagggaaacaagggcggttccgtcagaaccttctcggtaaacgtgtagactactcaggccgttccgttatcgtcgtaggcccgcacctgaaaatgtatcagtgcggtttgccgaaggaaatggcgcttgagctcttcaagcctttcgtcatgaaagagcttgttgaaaaaggccttgctcacaatatcaagagcgcaaaacgcaaaatcgaacgcgtgcagcctgaagtatgggatgtacttgaatctgtcattaaggagcatccggtcttactgaaccgtgcccctactcttcacagattaggtatccaggctttcgaaccgacgcttgttgaaggacgcgccatccgtcttcacccgttagtatgcacagcttataacgctgactttgacggtgaccaaatggcggttcacgtacctttatcagctgaggctcaagctgaggcgcgcattctgatgcttgcagcccaaaacatcttgaaccctaaagatggtaaaccggttgttacgccgtctcaggatatggtattaggaaactactacctgacgcttgagcgcgccggagcagtcggcgagggtatggttttcaaaaatacggacgaagcgcttcttgcttatcaaaacggttatgttcaccttcatacgagagtagctgttgcagcgaactcccttaagaatgtgacatttactgaagaacagcgttcaaaattgttaattacaactgtcggtaagctcgtcttcaatgaaattcttccggaatcattcccttacatgaatgaaccaacgaagagcaacattgaagagaagacacctgaccgtttcttcttagataaaggtgctgacgtaaaagctgtgattgctgagcagccgatcaacgcaccgtttaaaaaaggcattttgggtaaaatcatcgcggaaatctttaaacgattccatatcacggaaacgtctaaaatgcttgaccgcatgaaaaaccttggtttcagatattcaacgaaagccggcatcacagtaggggtttctgatatcgtcgttctcgatgataaacaggaaatccttgaagaagcacaaagcaaagtggataatgttctgaaacagttcagacgcggtttaatcaccgaagaagaacgttatgaaagagtcatttcaatttggagttcagcgaaagatgttatccaaggcaaactgatgaaatcattagacgaagtcaacccgatctacatgatgagtgattcaggagcccgtggtaacgcatctaactttacacagcttgcgggtatgcgcggtctgatggccaacccggctggacgaatcattgaattgccgattaaatcaagtttccgtgaaggtctgacagtattggagtactttatctccactcacggtgcgcgtaaaggtcttgccgataccgccctgaaaacagctgactcaggttaccttacacgccgtcttgttgatgttgcgcaggatgttatcattcgtgaaacagattgcggaacagaccgcggtattcttgcaaaaccgctcaaagaaggcacggaaatcatcgagcgtctggaagagcgtctgatcggacgtttcgccagaaaacagatcaaacatcctgaaacgggtgctgtgctcattaacgaaaatgaattgatcgatgaagataaagcgctggaaatcgttgaagccggaatcgaagaagtgtggatccgttccgcgttcacatgtaacactcctcatggtgtatgtaaacgatgctacggacgtaaccttgcaaccggaactgatgttgaagtcggcgaagcagtaggtattatcgccgctcaatctatcggtgagcctggaacacagttaacgatgcgtacgttccacacaggcggggttgccggagacgatattacacaaggtcttccgcgtatccaagagcttttcgaagcgcgtaatcctaaaggtcaagcgacgatttctgagattgacggtacaattgccgaaatcaatgaagtccgcgacaaacagcaggagattgttgttcagggcgctgttgagacccgttcatacacggcaccttacaactcacgcctgaaagtggctgagggtgatcagattacccgcggtcaagtgctgacagaaggttcaatcgatccgaaagaacttcttaaagtcactgacctgacgacggttcaggaatatcttctgcatgaggttcagaaggtttaccgtatgcagggggttgaaatcggcgataaacacgtagaagtaatggttcgccaaatgcttcgcaaagtccgtgtaatcgatgccggagatactgatgttctccctggcacattgcttgatattcaccaatttacagaagcgaacaaaaaagtgctgcttgaaggcaatcgacctgctacaggccgtcctgtccttctcggtatcacgaaagcttcactcgagacggattcattcttgtctgccgcatcattccaggaaacaacacgcgttcttacagatgctgcgattaaaggcaagcgcgatgaacttctcggcctgaaagagaatgttatcatcggtaaactggttcctgccggtaccggtatgatgaattacagaaaagtaaaacctgtttcaaacgttcagccttcggaagatatggttccggctgaataacagaaactgctgcaggaaaggctgttttgacagcttttcctcagtattacaattattctggcggggactgcactaaaaaatgtcatacgttgttgacatccgtcccgcagagtgataatataaccaaggtgctcgaaataaaacctgttactttggaggatatgtttatgtcttatgataaagtatcacaggccaaatcaattattattggtacgaagcaaacagtgaaagctctaaaacgaggttcagtgaaggaagtcgtcgtggcaaaagatgcggattcagttcttacggctggcgttatccagcttgcaaagaaccaaaataccgctgtctgtatggtggattccatgaaaaagctcggcaaagcctgcggaattgaagtgggagcagcagctgttgccattatgttatagcgtactttttgtttttatataagatatcaatcttgtgtaaagacattgttttttgcctaatgatgaaccacctgggtatgtgggttataaaacgtaatgaagggaggaacacaacatgcctacaattaatcagctaattcgcaagggacgcgtgagcaaagttgaaaactctaagtcacctgcactaaacaaaggatacaacagctttaaaaaagagcacactaacgtatcttctccacaaaaacgcggggtatgtactcgtgtgggtacaatgacaccgaaaaaaccgaactcagcacttcgtaaatatgctcgtgttcgtttgactaacggaatcgaggttactgcctacattccaggtatcggtcacaacctgcaagagcacagcgttgtactgatccgcggcggacgtgtaaaagacttaccgggggtacgctaccacatcgttcgtggcgcgcttgatactgccggagttgaaaaccgtgcgcaaggccgttctaaatacggtacgaaacgtcctaaagcaaagtaataataataaatcattaaaactatgaagggaggatattcagatgccacgtaaaggtcctgtagcaaaaagagatgttttacctgatccgctttacaactctaagctggtatcccgcctgatcaacaaaatgatgatcgacggtaaaaaaggtaaatctcaaacaatcctatacaagtcattcgatatcattaaagaacgcactggcaatgatgcaatggaggttttcgaacaagcattgaaaaacatcatgcctgtacttgaagtaaaagcacgccgtgtaggtggagctaactaccaagtgcctgtagaagttcgtcctgaacgccgtacaactcttggtcttcgctggttggttaactatgcgcgtcttcgcggagaaaaaacaatggaagagcgcctggctaacgaaattcttgatgcagctaacaacactggtgctgccgttaagaaacgtgaagacactcacaagatggcagaagcgaacaaagcatttgctcactaccgctggtaggattcatataatcaaaataataattccctaataaggaaggagaaattacccaatggcaagagagttctccttagaaaaaactcgtaatatcgggatcatggctcacatcgatgccggtaaaacgactactacagaacggatcttgttctacacaggccgtatccacaaaattggcgaaactcacgaaggtgcttcgcaaatggactggatggagcaggaacaagaacgcggtatcacaatcacttctgcagcaacgactgcacagtggaaaggttaccgtgtaaacatcatcgatacaccgggacacgtagacttcacagttgaagttgaacgttcactccgtgtacttgatggtgcggttgccgtacttgatgctcaatcaggtgttgagcctcagacagaaacagtatggcgccaagcaacaacttacggagtaccgcgtgttgtatttgtcaacaaaatggacaaaatcggcgcagacttcctttactctgtaggcactttaagagaccgtcttcaagctaacgctcacgcaattcaattgccgatcggcgctgaagacaacttcgaaggtatcatcgacttagtagaaaacgttgcgtatttctacgaagatgaccttggaactcgttcagatgcgaaagaaatccctgaagagtacaaagagcaagctgaagagcttcgcagcagcctgattgaagctgtagctgagcttgatgaagagcttatggaaaagtaccttgaaggtgaagaaatcactatccctgaactgaaagctgctatccgtaaaggtacactgaatgttgaattctaccctgtacttgttggatctgctttcaaaaacaaaggtgttcagcttgtacttgatgctgttcttgactaccttcctgcgccaactgatgttgctgcaatcaaaggtgtacgtcctgacacagatgaagagatcgttcgtcattcttctgatgaagagccgttctctgcacttgcatttaaagttatgactgacccttatgtcggtaagctgacattcttccgcgtatattccggtacacttgattccggttcatatgtaaagaactctacaaaaggcaagcgtgagcgcgtaggacgtatccttcaaatgcacgctaacagccgtgaagagatctctactgtttacgctggagacatcgcagctgctgtaggtctaaaagatacttctactggagatactctatgtgatgaaaaggatcttgtaatccttgaatcaatggaattcccagagcctgttatcgacgtagcgattgagcctaaatcaaaagctgaccaagataaaatgggtatcgctttagcgaaacttgctgaagaagatcctacattccgtacacaaacaaaccctgaaacgggtcaaacaatcatctctggtatgggtgagcttcaccttgatatcattgttgatcgtatgaagcgtgagttcaaagttgaagctaacgttggtgctcctcaagttgcgtaccgtgagacattccgtaccggtgcaaaagttgaaggtaaattcgtacgtcaatcaggcggacgcggtcagttcggtcacgtttggatcgaatttgaaccgaacgaagaaggcgctggctttgaattcgaaaacgcaatcgtcggtggtgttgttcctcgtgaatacatcccagccgtacaagcaggtcttgaagactctcttgaaaatggtgtcctagccggattcccgctaatcgacatcaaggcgaaactttttgatggatcttaccatgatgttgactcaaacgaaatggcgtttaaagtcgctgcttctatggcattgaaaaatgcagtcagcaaatgtaacccagttcttcttgaaccaatcatgaaagttgaagttgttattcctgaagaatacatgggagacatcatgggtgatgttacttctcgtcgcggacgcgtagaaggtatggaagctcgcggtaacgctcaagttgtgcgtgcgatggtacctcttgctgaaatgttcggttacgctactgcccttcgttctaacacgcaaggacgcggtacgttcacaatgttcatggatcactacgaagaagtgccgaagagcatcgctgaagaaattatcaaaaaaaataaaggcgaataattgattttgccacttaactcaagtataactactattgtaagatgaggaagtgagagcttgctttcactttctatcactctatacattactaattaaaagctcttaaggaggattttagaatggctaaagaaaaattcgaccgttccaaatcacatgccaatatcggtacaattggacacgttgaccatggtaaaacaacattaactgctgctatctcaacagtacttcataagaaatctggtaaaggtacagctatggcgtacgatcaaattgatggtgctccagaagaacgtgagcgcggtatcacaatctctactgcacacgttgagtacgaaactgacactcgtcactatgcacacgttgactgcccaggacacgctgactatgttaaaaacatgatcactggtgctgcgcaaatggacggagctatccttgtagtatctgctgctgatggcccaatgccgcaaactcgtgagcacatccttctttctaaaaacgttggtgtaccatacatcgtagtattccttaacaaatgcgacatggtagacgacgaagagcttcttgagcttgttgaaatggaagttcgcgatcttcttagcgaatacgacttccctggtgatgatgtaccagttgttaaaggttctgctcttaaagctcttgaaggcgatgctgagtacgaagaaaaaattcttgaacttatggctgcagttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagaaaacagcaaaacaactgttacaggtgttgaaatgttccgtaagcttcttgactacgctgaagctggagacaacatcggtgcacttcttcgcggtgtagctcgtgaagacatccaacgtggacaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatcaatcttccagaaggcgtagaaatggttatgcctggagataacactgaaatgatcgttgaacttatctctacaatcgctatcgaagaaggaactcgtttctctattcgtgaaggcggacgtacagttggttcaggcgttgtttctacaatcactgagtaatcgactcgttcattaatgcggggtcccttatggggcctcgtttttttgtttccccgctgattccatgtataatagaacgtatacaaattttaggagaagaccgatggacgataacttcaagaaaaccaatcgtatttcaatgcttcagcaattgctgattaatggcagtgaacaaaccattatgattaatggtgatgacaggagtaatccgctgcttttgtttttgcacggcggtcccggcacgcctcaaatcggctatgcgagaaaataccagaataagctggaaaagcatttcaccgttgtgaactgggatcagagaggggcgggtctctcttattcaaaggaaattccgggttcatctatgactttggatcagctgacagctgacaccattcagctgaccgaacgcttatgcgagcaattcagcaggcaaaaaatatatatcgccggctattcgtggggctcagttctggcgcttcatgttcttcaagagaaacctgatttgtattatgcgtatatcggtatcagtcaggtggttaatattcaaaaggaagaaacggaagcttaccggctgatgatggaatggagcaggcaacacaaacatatcctgctggaaaagacgctgagctttatcggagcacctccatgggagaaacagctgcagcgaacgttgtttctgctttgtatcgagatgaggggagggggctttacccatcatccgatcggcgctcttaaagcaggggggcgaatgctgtttggtgaaccgtacggtgtgagggggagcttcttagccgcgcggggacaaatgttcagcctgaaacacctgtgggaggatctcatttcctttgatgcaggggaatcagtttcttctattgtaataccgtgctgttttatgtcagggagatacgatttgacggtaccggggacgacgtcttatgaatattatcagaaggttgacgcgccgtataaagaatggcattggtttgagaactcagcccattcgcctcacttggaggaaccggatcgctttgccgaagttgtcagccggttcgcatcgttccatctctgaaagaaaacaggcatatccttgattaatcatggtatcacctgtataataatcaaagtgtgaaaaccacaaggttctttaaataaaccttgcaacatgcgtctattttctgtataatagtgtatgttggtctttgactgcgatgaagtgagaggttgctgacacacccggccgctttgccatggcaaggtgatcaggtttttctcacggagaactgtctaacgtgatgtaggcgaaaaggagggaaaataatggcaaaacaaaaaattcgtattcgtttaaaagcatatgatcatagaatccttgatcaatctgcagagaagattgttgaaacggcaaaacgttctggtgccagcgtatctggtccgattccgttgccaactgaaaaatcagtttacacaatccttcgtgcggtgcacaaatacaaagattctcgtgagcaatttgaaatgcgtacacataaacgtttaatcgacattgtgaacccaacaccacaaactgttgatgctctcatgcgattagacttaccatctggtgtcgatatcgaaatcaaactttaattctaaaatatagaatgatcttaataggaggtgtgacgaatgaccaaaggaatcttaggaagaaaaattggtatgacgcaagtattcgcagagaacggtgatcttatcccggtaactgttattgaagcagctccaaacgttgttcttcaaaagaaaacagctgaaaatgatggctatgaagcgatccagcttggttttgacgataagcgcgaaaagctttcaaacaaaccggaaaaaggacacgttgcaaaagcggaaactgctcctaagcgcttcgttaaagaattacgcggcgtggatatggatgcgtatgaaattggtcaggaagtcaaggttgaaattttctctgcaggagaaatcgtagatgtaacaggagtatctaaaggtaaaggtttccaaggtgcaatcaagcgccacggacaatctcgcggacctatgtctcacggttcacgctaccaccgtcgtcctggttcaatgggacctgtagatcctaaccgtgtattcaaaggtaaactattacctggacgcatgggcggagatcaaatcactgtccaaaaccttgaagtcgtaaaagtagatgctgagcgcaatcttcttttgattaaaggtaacgtacctggtgcgagaaaagctttaatcactgttaaaagtgctgttaaatctaaataagtctcttaggaaaggaggaaattgatcatgccaaaagtagcattatacaaccaaaacggttctactgctggtgatatcgaattaaacgcttctgtatttggaattgagccaaatgagagcgtagtattcgacgctattcttatgcaaagagcttccttacgtcaaggatctcacaaagtaaaaaatcgttctgaagtacgcggcggaggtcgcaaaccatggcgtcaaaaaggtacaggtcgtgcccgtcaaggttcaatccgttcaccgcaatggcgcggaggtggtgtcgtattcggcccaacaccacgcagctattcttacaaattacctaaaaaagttcgccgcttggcaatcaaatcagtattgtcttctaaagtgaacgacaacaacattattgttcttgaagatcttactcttgatacggttaaaacaaaagaaatggcagctgtccttaaaggattatctgttgagaaaaaagctttaatcgtaactgcggatgcaaacgaagcagtatctctttctgcacgcaacatccctggagttacagttgttcaagctaacggaatcaacgtgttagacgttgtcaaccacgagaagcttctgattacaaaagctgcggttgaaaaagtagaggaggtgcttgcataatgaaagatcctcgtgatgttcttaagcgccccgtcattactgaacgttctgctgatttaatgactgaaaaaaaatatacttttgaagttgatgtaagagctaataaaacagaagtgaaagatgcagttgaaagtatctttggagtgaaagttgacaaagtcaacatcatgaactacaaagggaaatcaaaacgtgtcggccgctacactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaacggacgtcgtggcatgacaacttcagattttgctgaaatcacgactgaccagccggaaaaatccttgcttgcgccccttcacaaaaaaggcggacgtaacaaccaaggtaaattgactgtacgtcaccaaggtggcggacacaaacgccaataccgtgttatcgacttcaaacgcgataaagatggtatacctggacgcgttgctacagttgagtacgatccaaaccgttcagctaacattgcactaatcaactatgtagacggagaaaaacgttacattcttgcaccaaaaggaattcaagtaggtactgaaatcatgtccggccctgaagctgacatcaaagtaggtaacgcacttccgcttatcaacatccctgttggtacagttgtgcataacattgaattaaaacctggtaaaggcggacagcttgtacgttcagctggtacatctgctcaggtccttggtaaagaaggcaaatacgttcttgtacgtcttaactctggtgaagttcgcatgatcctttctgcttgccgcgcttctatcggtcaagtaggtaacgagcagcacgaacttatcaacgttggtaaagcaggacgctctcgctggaaaggcatccgccctacagtccgcggttctgtaatgaaccctaacgatcacccgcacggtggtggtgaaggtcgcgcgccaatcggacgtaaatcaccaatgtctccttggggcaaaccgactcttggattcaagacacgtaagaaaaagaacaaatctgataaatttatcgtacgtcgtcgtaaaaataaataacggggttgtctacggttcatttcggaccgtagtgcaatcacgaagggaggttccaaaatggctcgcagcttgaaaaaaggaccatttgtcgatggacacttgatgacaaaaatcgagaaattaaatgaaacggacaagaaacaagttgtaaaaacttggtctcgccgttcaactattttcccacaatttatcggtcacactatcgcagtatatgacggacgtaaacacgtgcctgtattcatttctgaagacatggtaggccacaagttgggcgaattcgcaccgactcgtacttacaaaggccacgccagtgacgataaaaaaacaagacgctaagagaggaggcttttaaatgcaagctaaagctgttgcaagaacagtccgtattgctcctcgtaaagcacgtctagtaatggacctgattcgaggtaagcaagtaggcgaagcagtatctatcttgaacctaactccgagagctgcttctccgatcatcgaaaaagttttaaaatctgctgtcgcaaatgctgagcacaactacgagatggacgctaacaatctggttatttctcaggcatttgttgacgaaggcccaacgttaaaaagattccgcccgcgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaattcattagcaaacgcctttctgacgcttctgtttctaaagtagaaatcgagcgtgcagcaaaccgcgttaacattacgatccacactgctaagcctggtatggtaatcggtaaaggcggatctgaagttgaagcacttcgtaaagcccttaacagccttactggcaagcgtgtacacattaacattcttgaaatcaaaagagcagatcttgatgctcagcttgtagctgacaacatcgctcgtcaactagaaaaccgtatttctttccgccgtgcgcagaaacaacaaatccaacgcactatgcgtgctggagcacaaggtgtgaaaacaatggtttccggccgtcttggcggagctgatatcgctcgttctgaatactacagtgaaggaactgttccattgcacactttacgtgctgacatcgactatgcaacatctgaagctgacacaacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgcggtcgcgctaaaggcggtactgaagtacattttggtgagtacggtatccaggctcttgaagcttcttggatcacgaaccgccaaatcgaagctgcacgtattgcgatgactcgttacatgaaacgtggcggtaaagtttggattaaaattttcccttcaaaaccttacactgctaaaccgcttgaggtacggatgggttccggtaaaggggctcctgaaggctgggtagctgttgtaaaaccgggcaaagttttatttgaaatttctggtgtgtctgaagaggtagctcgtgaagctcttcgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgccaataaataatcactgaggggaggtcgtgagcatgagcgaacgtaaccaacgcaaagtttaccaaggccgtgttgtttctgacaaaatggataaaaccatcactgttgttgttgaaacatacaaaaaggatcctatttacggtaaacgcgtaaaatactcaaagaaattcaaagcacatgatgaaaataaccaagctaaaatcggagacatcgtaaagatcatggaaactcgtccattatctgcaactaagcgttttcgtctagtagaagttgtcgaagaagctgttattatctaataaagatcggaattctttttccgaagggaggtaacaaataatgattcaacaagagactcgtttaaaagttgctgacaactccggtgcgcgtgaggtacttactattaaagttctaggcggttctggacgtaaaacggctaacattggtgatgtaattgtttgcacggttaaacaagcaacacctggaggcgttgtcaaaaaaggtgaagtcgtaagagctgttatcgttcgcacaaaaagcggagcacgcagaactgacggatcatacatcagcttcgatgagaatgcatgtgttatcatccgtgacgacaagagcccgcgtggaactcgtatcttcggaccggttgcccgtgaattacgtgaaaacaacttcatgaaaattgtttctctggctccagaagttatctaatgaaataaatgccttactcaaggaggtgcgatcaggatgcatgtgaaaaaaggcgataaagtaatggttatctctggtaaagataaaggcaaacaaggtacgatccttgctgctttccctaaaaaggaccgcgttctagttgagggcgtaaacatggtgaagaagcactctaaaccaactcaagcaaaccctcaaggcggtatttctaatcaagaggcgccaattcatgtatcaaacgttatgccgctcgatcctaaaacaggtgaagtgactcgcgtaggatacaaagtggaagatggcaaaaaagttcgtgttgcaaaaaaatctgggcaagtcttagataaatagtatttaaaggaagggaggtctatctcatgaaccgccttaaagaaaagtacaataaagaaatttcacctgctttaatgacgaagttcaactacgactctgttatgcaggtgccaaaaatcgaaaaaatcgtaatcaacatgggtgtcggtgatgctgttcaaaacgcaaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcgggatttctaagaaatctttcgacggtcgcggaaactacactcttggtatcaaagaacagttaatcttccctgaaattgactacgataaagtaacaaaggttcgcggaatggacatcgttatcgtaacgactgctaactctgacgaagaggctcgtgagctattaactcaagtaggtatgccgttccagaaataatcaatgaaagggaggcgaaatcgtggctaaaaagtcaatgattgcgaaacaacaacgtacaccaaagtttaaagtgcaagagtacactcgctgtgaacgctgcggacgtccgcactcagtcattcgtaaatttaaactttgccgtatttgtttccgtgagcttgcatataaaggacaaattcctggcgtgaaaaaagccagctggtaatccccaagaatgggaaggaggtaattatataatggttatgacagatccaattgcagatatgctgactcgtattcgcaatgcaaacatggtacgtcatgagaagcttgaaattcctgcttctaaattgaaaagagaaattgctgacattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaaaccaggtttgcgtgtatacgctaaatcaaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacaagaatggaggtgttttagtatgtctcgtgtaggtaaaaaactgcttgagatcccttctggagttacagtaacgctgaacgaaggcaacactgtagctgtaaaaggaccaaaaggagaattaactcgtactttccatcctgatatggaaatcaaaattgaggacaacgtgcttacagttactcgtccttctgatcacaaagagcaccgtgcgctgcatggtacgactcgcagtctgcttggaaacatggttgaaggcgtatctaaaggatttgaaagaggtttggaattagtcggtgtcggttatcgtgcggctaaatccggaaacaaacttgttttaaacgttggatactctcaccctgttgagatcgttcctgaagagggcatcgaaatcgaagttccttctcaaactaaagtagttgtaaaaggtacagacaaagagcgtgtaggagctatcgctgctaacatccgcgctgtacgttctccagagccttacaaaggtaaaggaatccgctacgaaggtgaagttgttcgccgtaaagaaggtaaatctgctaagtaagaccgcttaaagtgaagaaaggagtgacctaaggatgattacgaaaactagcaaaaatgctgctcgtcaaaaaagacatgcccgtgttcgtgctaaactttcaggcacagctgaaagacctcgtctgaatgtgttccgttcaaacaaacacatttatgctcaaatcatcgatgatgtaaatggcgttacacttgctagtgcctctactctcgataaagatttgaacgtggaaagcactggtgacagcgctgctgctgctaaagtcggtgaactcgttgcgaaacgcgcttctgagaaaggtgtttctgacgtagtatttgaccgcggcggatacttataccatggacgtgtaaaagctctggccgatgcagctcgtgaagccggactgaaattttaataaaaaaaggagggacacatgattatgcgtcgtattgacccaagcaaattagagttagaagaacgcttagttacggttaaccgcgtagcgaaagttgttaaaggtggtcgtcgtttccgtttcgcagctctagtcgttgtcggtgacaaaaacggtcacgtaggtttcggtactggtaaagcacaagaagtacctgaagcaatccgcaaagctgttgaagatgcgaaaaagaatttgattgaagtaccaatggttggaactacgattccacacgaaatcatcggacgtttcggtgcaggcaatatcttgttgaaacctgcttctgaaggtactggagttatcgctggaggccctgtacgtgcggtacttgagcttgctggcgttgctgatatcctttctaagtctttaggttctaacacaccgatcaacatgatccgtgcaacacttcaaggtttaagtgagcttaaacgtgccgaagacgttgcgaagcttcgtggaaaatctgtagaagaactgttaggataaggagggaacattaatggctaaattagaaattaccctcaaacgcagtgtaatcggtcgcccggaagatcagcgcgttactgtaagaacacttggtttaaagaaaacaaaccaaactgtcgttcatgaagataacgctgcgatccgcggtatgattaataaagtatctcatctagtttctgttaaagaacaataaaaataaattataggctaaggaggtgtcctaatgaaacttcatgaattaaagccttcagaaggttcacgtaaagtacgcaatcgcgtaggtcgtggtattggttctggtaacggtaaaacagctggtaaaggtcacaaaggtcaaaacgctcgttctggcggcggtgtacgccctggattcgaggggggacaaatgcctttattccaacgtcttcctaagcgcggttttacaaacatcaaccgtaaggaatacgctattgtgaacgtagacaaattgaacggttttgcggaaggaacggaagtcactcctgaacttcttcttgagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaagacaatctccaactttatgcgtgtgagtgatattcggaataaaatcatttttacattactcatgcttatcgtctttcgcataggtgcgtttatccctgtgccatatgtaaatgctcaggcgttgcagacacaaagttcgatgggggtttttgatctccttaacacatttggcggcggtgcgctttatcagttctccatttttgcgatgggaattacgccttacatcactgcttcgatcatcattcagctgcttcagatggatgttgtgccgaagtttaccgagtggtctaagcaaggtgaagtcggccgccgtaaattagctcagttcacgagatattttacgattgtgcttggttttatccaggcattaggtatgtcttacgggtttaacaacctggcaaacggtatgctgattgaaaaatccggcatatcgacatatctgattattgctttagtactcactggaggaactgcttttttaatgtggctgggagaacaaattacttccaatggagtaggtaacggaatttcgatcatcatcttcgcggggattgtggctagtattccgaaaactgttgggcagatttatgagactcaatttgtcggcagcagcgatcagctgtttattcatattgtaaaaatcgctttactggtgattgcgattttggccgttattgttggtgttattttcattcagcaggccgtacgcaaaatcgcgattcaatatgcaaaagggcaaggtcgttcacctgttggcggaggccagtcaactcaccttccgcttaaagtgaatccggcaggggttattccggtaatctttgcggttgcgttccttattacgccgcgtactatcgcgtcatttttcggagaaaacgatgtgacaaagtggattcaagccaactttgacaatacacatccggtgggcatgacggtttatgtcgcattaattatcgcctttacgtacttctatgcttttgtgcaggtaaaccctgaacaaatggctgataacctaaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacagattggcggaacatcattgttaattgtcgtcggggtagccttggagacaatgaagcagctggagagccagttagtgaaacgtaattaccgaggatttatgaaaaattagaggactggttttaaccattcctctaaataagagaggacgggggaaatccgaatgaacttagtcttaatgggacttcctggagccggtaaaggcacacagggagaacgaattgttgaggattatgggatacctcatatctcaacgggagatatgttccgtgctgctatgaaagaagaaacaccactcggactcgaagcaaagtcttatattgataaaggcgagctcgtaccggacgaagtcacaatcggcattgtcaaagaaagactcggcaaagatgattgtgaaagaggttttcttctggacggatttccgcgaacagtcgctcaggctgaagctcttgaaaacattcttgaggaatacggcaagccgattgattatgtcattaacattaaagtagacaaagactctttaatggatcgtttgactggacgcagaatttgcagtgtttgcggcacaacctatcatttggttttcaatccgccgaaaacgccgggtgtttgtgataaagacggaggagacctttatcaacgggcagatgataatgaggaaaccgtctcaaaacggcttgaggtcaacatgaagcagactcagcctttactcgatttttattctgagaaagggtatcttgtcaacgtcaatggccagcaggacattaacgacgtgtacaaagatgtgaaagagcttcttggaggattgagcaaatgattatctgtaagacccctcgtgagcttagcatcatgcgggaagcagggcgaatcgtggctttgactcatgaagagatgaaaaagcacattaaaccaggaatctcgacaaaagaattggatcaaattgccgaacgttttattgagaagcagggtgcaatcccatcttttaaggggtataatgggtttcgcgggagcatctgtgtatcagttaatgaagaactcgttcacggaattcccggtaaaagggttttgcgtgacggtgacattatcagcattgatatcggtgctaaattaaatggttatcatggtgactctgcttggacatatccggtaggaaacatcagtgatgatgataaacgactgctggaagtgacagaggagtctttatataaaggcttgaaggaagcaaaaccaggtgaacgtttgtcgaatatttcccacgcaatacaaacgtatgtcgaaaatgagcagttttcagttgttagggagtatgtcggacatggtgttggtcaagacttgcatgaggatccgcaaattcctcattacggtccgccaaacaaaggacctaggctgaagcctggtatggttctcgctatagaaccgatggttaacgctggcagccggtatgtgaaaacattggctgataactggacggttgtaacggtagatgggaaaaagtgtgctcattttgaacatacgattgcgattacggaaacgggttttgatatactgacaaaagtctagatgatgaaatgaattccatgacacatgtttttcattccgcacctgggcagattgtaggtttacaattggtcggaagaaaaaccggctagctgctgtcatcggaatgaagattcatcatcgtgtactaaagcagacggagaaaagcgtacatttcattctccttagaaaaagaatatcaatcattcaccctttatgattgcgtatctccggaagttcagaacagtataaacgaaacagggcgtgtgacaaacggataactgagattttctcttttgaaatttgtcagagagcaagttactgatttgaagaagggagaacacttgaatggcgaaagacgatgtaattgaagtggaaggtacgattgtcgaaacactgccaaacgcgatgttcaaagttgaactcgaaaatggccatacggttttggctcacgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgagaaatgtaaagttattcgcagaaaaggaaaagtaatggtgatctgtgaaaatccaaagcataaacaaaaacaaggataattaataaggaggtgcccagagaatggctcgtattgctggtgtagatatcccacgtgacaaacgtgttgttatttctttaacatatgtcttcggaattggccgcacaacggctcagcaagtcttgaaagaggctggtgtttctgaagatactcgtgtgcgtgatcttactgaagaagaacttggtaaaatccgtgatgttattgacaaactgaaagtagaaggtgaccttcgccgtgaagtttctcttaacatcaagcgtctgatcgaaatcggaagctaccgcggaatccgccatcgcagaggtttgcctgttcgcggacaaaactctaaaaacaatgcgcgtactcgtaaaggtccgcgtcgtactgtagctaacaagaaaaaataagtaagggaggtacctaaacaatggctgctgctcgtaaacaaaacacgcgtaaacgtcgcgtgaaaaagaatattgagtcaggaatcgctcatattcgttcaactttcaacaacacgatcgttacgatcactgatactcatggtaatgctatttcttggtcaagtgccggagctctaggattcagaggttctcgtaaatcgactccttttgctgcgcaaatggctgctgaaacagctgctaaaggttcaatcgaacacggacttaaaactcttgaagtaactgttaaaggaccaggttctggccgtgaagctgcaatccgtgctttacaagctgccggacttgaagttacagctatcagagacgtaactcctgttcctcataatggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccgcttgagcgtggatatggtacaactctgggtaactccttacgtcgtatcctcttatcctcactccctggtgccgctgtaacatcgatccagatagatggtgtactgcacgaattctcgacaatcgaaggcgttgtggaagatgttacaacgataatcttgcacattaaaaagcttgcattgaaaatctactctgatgaagagaagacgcttgaaattgatgtacagggcgaaggaactgtcacagcagctgatattacacacgacagcgatgttgaaatccttaatccggatcttcatatcgcgactcttggtgagaatgcgagtttccgagttcgccttactgcacaaagaggacgtgggtatacacctgctgattcgaacaaaagagacgatcagccaatcggcgtgattccgatcgattcaatctttacgccagtttctcgtttatcttatcaggtagaaaacactcgtgtaggccaggttgcaaactatgacaaacttacacttgatgtttggactgacggaagcactggaccgaaggaagcaattgctctcggttcaaagattttaactgaacaccttaatatattcgtcggtttaactgacgaagctcagcatgctgaaatcatggttgaaaaagaagaggaccaaaaagaaaaagttcttgaaatgacgattgaggaacttgatctttctgtccgttcttacaactgcttgaagcgtgcgggcattaacacggttcaagaacttgcgaacaagacggaagaagatatgatgaaagttcgcaacctggggcgcaaatcacttgaagaagtgaaagcgaaacttgaagaacttggactcggccttcgcaaagacgattgatctagtttccatgtgaactaggattttcgtgtgttttttaattagaaacagcattccattaaaggaggggacatcacatgtcatacagaaaactaggacgtacgagttcacagcgtaaagctatgcttcgtgatcttacaacagatttgatcatcaacgaaagaattgaaacaactgaaacacgtgcgaaagaacttcgctctgttgttgaaaagatgatcactcttggtaagcgcggtgacttgcatgctcgtcgtcaagctgctgcatacattcgcaacgaggttgctaatgaagaaaataaccaagatgcacttcaaaaattattctctgacattgcaactcgttacgaggagcgccaaggcggatacacacgtattatgaagcttggtcctcgccgtggtgacggtgcaccaatggcaatcatcgaattggtttaatcacatatttttgtgtatctaaagaagggcgggacagtttctaactggatctatgccctttttttagatatcagaactttttatcatgagacagaaaagcagagctatagctgagaggaggtcaggcgcccgtggatcaaaaacagcttatatccgtaaaagacattctattccgttaccgcaaagatgcagaaagaccggcgctggacggtgtgagtctggaggtatacgaaggagaatggcttgctatcgtaggccacaacggttcagggaagtcgactttggccagagcgctgaacgggctgattttgcctgaggccggagaaattgaagtcggcggcatcaagctgactgaggataccgtgtgggatgtgcggaaaaaaatagggatggtctttcagaatcccgataaccaatttgtcggaacgactgttcgcgatgatgtggcttttggtttagaaaacaatggtgttccgcgcgaagaaatgattgagagagtagattgggctgtcacacaagtcaatatgcaggattttcttgatcaagagccgcaccatctctccggaggtcaaaaacaaagagtggcgatcgcgggaattattgccgcgcgtcctgatattatgattttggatgaagcgacatccatgcttgacccgattgggagagaagaagtccttgatactgtcagacgcttaaaagatcagggcatggccaccgtcatttcgataacacatgacctggaagaagccgcaagggcggacaggatcattgtgatgaacggcggcaggaaatatgcagagggcacgcctgaagagatttttaaattaaatgaagacttggttcgcatcggtcttgatttgcctttctcattccagctcagcctgcttttgaaagaaagcggactggcgttaacgaaaaaccatctgactcaggaagggctggtgaatgagctgtggacattaaaatcaaagatgtagaacaccgctatcaaatgaagacaccgtttgaacggcttgctctgtatgatatcaatgccgtgataaaagagggcagctacgttgccgtcatcgggcatacagggtcgggcaaatcgacgctcctgcagcatttaaacggtttgctgaaaccgactaaaggacagcttgagctcgggagcacgattctggcagccggtaaaaaaaataaagaccttaagactttgcgaaaaaaagtcggaatcgttttccaatttcccgaacatcagctgtttgaagagactgtgctgaaggacatcgcattcggaccgatgaatttcggtgtaaaaaaagaagacgctgaacggaaagcaaaagaaatgctggggcttgtgggccttccagaagacattttggatcgttcaccgtttgagctcagcggcggccagatgcgcagagtggcgattgccggcgttctcgcgatggagccggaagtgctggttttggatgaaccgacggccggtcttgatccgagagggcgccaggacattatggacatgttctatgcgcttcatcagcggggaaacctgactaccgttctcgtcacccacagcatggaggacgccgcccgctatgctgacgaaatgatcgtcatgcacaaaggaaccattaaagcgacgggaagtccgcgtgacttgtttgtaaaaggtgaagagatggccgaaatgggactggatcttcctgagtcggtgaagtttcagagacggcttgagaaggctctcggagtcaagtatgagaaacccatgctgaccctgcaggatgccgccagtgaaattaaggctttctttcaggaggaaaaggaccaatgatggacagcatgattatcggaaagtatgttcccggatcatcgcttattcaccgattggacccgcgaacaaaacttgtcagcatctttctttttgtatgtatcgtttttttggcaaacaacgtacagacgtacgctttgctcggtttgtttacattcggggtgatcgccttaacacgagtgccgttcagctttttgctgaaggggcttaagccgattatctggattgtggcgtttacctttttattacacattttcatgacgcatgaaggatctgtcatttttcagcttggctggtttaaagtgtatgagggcggacttatacaggggatttttatctccctccgtttcgtttaccttatctttatgacgacgctgctgacgctgacaacaacgccgattgaaataacggatggaatggagcagctcctgaatccttttaaaaaggtgaagctgcctgtacacgaactcgcattgatgatgtcgatatcattgcgatttatcccgacattaatggaagagacagataaaatcatgaaggcgcaaatggcgaggggtgcggactttacaagcggcccggtgaaagacagaatcaaagcggttgttccgctgcttgtcccgctgtttgtcagcgcctttaaacgcgcggaagagcttgcggtcgccatggaggcgagaggctaccagggcggtgaggggagaacgaaatacagaaagctcgtctggaccggaaaggataccggagccattctgctcatcatcgtattagccgtgttattgtttttcttaagaagttagaggtgctgctgaatgagagtgaaatgtaccattgcttatgacgggcatttatttaacggatatcaggttcagcctggaaagcggaccgttcaaagtgaattggaaaaagcgctggctgttatccacaaaacggacggcagggtgcctgtgtactcatccggccgcacggacagcgatgttcatgctgccgggcaggtcattcattttgatacgccgctgtccatcccggctgagaaatggccgtttgcgctcaatgccctgctgcctgatgatattgccgtcaaaacagcagagattgcggatgatgggttccatgcacgatttagcgcggtccaaaaggaatatcgctactttgtatatacggagaaacacccggacgtatttaaacgacattacgcttaccattttgcatatcagcttaatgtgcagaaaatgagggaagcttcaaggcacctcatcgggacacatgatttcacaagcttttgcgcggctgataccgcggttcaggataaggtcagaacgatttacgagctggattggactgagaccggagacggcctgcagatgaggatcaccggaaacggttttctctataatatggtcagaatcattgccggaacgttattggatacaggagctggaaaattttctcccgatgatgtaaaagcaatgctcaaagcgaaggatcgcgaagccgcggggcgcaccgcaccggggcacgggctgtatttatggagcgtttgctatgacaactaaaccaggtgtaacattttcttgacagagtctgcataaagttataagatatcatatggtatgtatttcaaccccacgataagccccggaacttattgtgttgtgaaatagaacgtaacagaagtttatgaaaaaatgacagatcatttaggagggaattaaatgcgtacaacacctatggctaacgcaagtactattgaacgcaagtggttagttgttgatgcagcaggcaagactttaggacgtctttctacagaagttgcatctatccttcgcgggaaacacaaaccgacttacacaccgcacgttgatactggagatcatgtgatcatcatcaacgctgaaaaaatcgagttaactggtaaaaagttaactgataaaatctactaccgtcacacaatgcacccaggcggtctgaaatcaagaacagctcttgaaatgcgtacaaactaccctgagaaaatgcttgagcttgctatcaaaggcatgcttccaaaaggttctctaggtcgtcaaatgttcaagaaattgaacgtataccgtggttctgagcatccacatgaagcacaaaaacctgaagtttacgaacttcgcggttaattaaaaaggaggttaccaatttggcacaggttcaatattacggtactggccgtcgtaaaagttctgtagcgcgtgtgcgcttagttccaggagaaggtcgtatcgtcgttaataatcgtgaaatcagcgagcacattccatctccggctctaatcgaagatatcaaacaaccattaactttaactgaaacagctggtacttatgatgttttagtaaacgtacatggaggcggcttatctggtcaagctggagcaatccgtcacggtatcgctcgtgctttgcttgaagcagatccagaataccgtgcaacacttaaacgtgctggtcttctgactcgtgacgcccgtatgaaagaacgtaaaaaatacggtcttaaaggcgctcgtcgtgcacctcagttctcaaaacgttaatcgttttggattgcaaaaaccacaacttcttggttgtggtttttttgtatttttttctcatatcgaagaggttatccgatgtttttctagaattgtttgttatactctattcattaccaataaggagcgcagttataatgaataagttagtcatacataacagcaaggcatgggataaaaaagtcgaaacaggcaatgaatggacggttgcggttgattctcatacgattggtgaagcaaaaaaaggcaattggagcatcagaatgacccccggaaaagatgtgccggcggattggtttccgcccatagacggtctgaaggttctttgtcttgcttcaggaggaggacagcaagggccggtccttgctgctgcaggagcggacgtcaccatctttgacaattcggaaaaacagcttgcgcaagacagaatggttgccgggcgggacgatcttacgcttcggactgtcaaaggcagcatgaatgatctgagttgttttgatgatgagacatttgattttatcgtgcacccggtatcgaattgctttgttgatacggttcttccggtatggaaagaagctcatcgcgtattgaaaaaaggcgggtctttagtctccggttttgtaaatcccgtcgtgttcttatttgatatggatttagagcaggaaggcgtactaaaagtaaagtattccattccgttttcggatgaaaaagatctgagtaagaaaaaggtaaaggaacttattgataatcatgaagcgcttgaattcggccatacgctggaggatcaaattaaaggtcagattgacgcaggctttatggttgccggtttttacgaggacaaaggcggcctcgtgctggatgaatacattaatacatactccgtaacaagaagcattaaaatataaaaacggcatcccgtcagaggtgctgtttttttgcggctttttcctgcggacggctgatcacattagccgaaaccggttctattccaatttctctggcccaaaccgacagttgtcccatatggtgaatctcatgcgcaaggatgtggcggagaatatcttctttaggaaaggtttggtccatccagtccggcttaacaagatccggccctttgcgggagaccgcatgaataacatcctcccgatactgttcagacagctttctgagatcctgaatgctcgtatagtcagactcagcgggtaaaacatcatctttacctaaaatggcacgagcccagctgatctcgacatcaatgatatgaaataaagtccgcaagatgctctccattccgcctgtccgggttttcgtcagttcctcccggctcagcttttcacatatcataaaccactcgtcacgcaccgtccaattgtattgaaacagctttttcatcacgtcacctcagctctttattcttccagttaacatgaaactccttcatttgggaggatttccactatcaacaaagcatgctttttcccttttcctttcaaaataacagtaaaaaggagcgtggctggcaatggcagaagtattatctttttcagacgtgaaacggcagaaggattttgagcttgagaagagtttactaaaggagctgtcactgacgcagatcattcagtccgtaaaagcatgtcttacccctttgtttccctttcttcaagacgaaaacggcattctgagtgaaggatgcatagattttgcaattgaagcgtatttattaggcggcaggttcggcgtatttggctattatggtgagtctttgcagagggcaaacgcccgttcggctgaagaagaggaagaactgacggccgatttttttgaatatctttgcaattggacgcatgagcaatattcttccgttgaacaaaaagaaatctatgaagcgtcctgccggtttatcaacagctggtggacggaaggatttctgcaaagggaaaaacaatgtaagctccgcatgaggtaatcataatttcctcccttgtcccatacttattaataacggggacaagcgggagggaaagctatgacaaaaaagctgaaatggctcggttttttacttggctttatcatattattgtgtttattccggtttcaattccataatgatgattcctggcggccgtggagcctgccgctgagcgggaaaatcatctatctcgatccgggacacggcgggccggacggaggcgccacgggaggcagtcaccttgaaaaggacattactctcgaagtggcctccagggtcagagactatttgcaggagcagggagctttggtcattatgacgcgggagacggatactgatttagctcctgaagggacgagaggctacagccgacgcaaagcggaagatctgagaaagcgcgtggagatcatcaaccgttcagaggcggagctttatatcagcattcatctgaacgccataccgtcaccgagatggagcggcgcccaaagcttctactatggaaaatacgaagagaatgaaaaagtggcaaaatatatacaggacgaattgagaatcaatttggagaatacaacgagaaaggcaaaacggatacacggcatttacttaatgcagaatgtaaccaaaccgggcgcgctggtggaaataggatttctgtccaatcccgcggaagcgaaaaggctcggccagcctaaatatcaggacaaaatcgcttcttccgtgtataagggcgtattgagatacttcacagagaaaggagaccctcccgagtaaggagggtttttcgccgattctgcgtttaatatatggtataataccatttgtaaacgaatacacaaagggtgagggttcgatgataagagaagatgaagtaagaaatatagtcggaaacatgcgcgaaccttttcttcatagaccgctgggagaattggatgccattaaagaagtaaaggtcaagccggaaaaacggcatgtcagtgtaaaaattgcattggcaaaaacggggacggctgaacagatgggcattcagcaggaaatcgtatccgttttgaaagaagcgggtgcggaaactgtcggactgcggtttgaagagctgccggaagaaacattggcgaaattcagccggcctgctgctgaaagcgaaactctgctgaataggaaacatccgccggtctttcttgcggtggcaagcggaaaaggcggtgtcggcaaatcaacggtttccgtcaacctggccatttctcttgcgcggctcggcaaaaaagtcggcttgatcgacgcggatatatacggattcagcgtgccggacatgatgggtattacagttcgcccgacagttgaaggagaaaaactgcttcctgtcgaaagatttggagtaaaggttatgtcgatgggctttttcgtcgaagaaaacgctccggttgtgtggagagggccgatgctgggcaagatgctgaataacttcttccatgaggttgactggggagaggttgactatatcgttctcgatctgccgcccggcacgggtgatgtggcgctcgatgtacacacgatgcttccgagctgcaaagagattatcgtatcaacgccgcaccctacagccgcatttgtagcggcgagagcgggttctatggcgattaagaccgatcatgaagttgtaggggtcattgaaaatatggcttattatgaaagtgcaaaaaccggcgagagagaatatgtgttcggtcaaggcgggggagacaagcttgcagaggaattgcaggtgccgctgcttggcagaattcctttaaaacagcctgattgggacaaggaccagtttgcgccttctgtctatgacagaagtcatccgatcggggaaatttatatgggaatcgcccagaaagtcattgaaaaaacagctgaataaaaaaggggccgggatcaacacggcccggccttttattggctttctttttcagagcttgaagccgcttttttcaattcatcctcgaattgctttttgaaaagcgggctggaaagtgtctctgtaattacatcttctaagtaactgcggaacttttggcttttcaccagctcatagtattttttatccatgccggggtcctgcatgatctgcataaaacttttctgataatcagggtctttcatcagtttttttatgattttttcgtgctcgggctgaagcgtttttgcaaagctctcggcgaactttgagtcttcaaagatggttttccagaactccgcccctttttagaggtgagggttttctctattgtgcctttaatggcattttgatcaatcaccaatgcctcattcatcgcatcatcatttaatatttccttaattgctttttttccatcatctgtctttaatatatcaacaaccatttttttagtctggtcataatccatatccgctgcttggtcttttggagcacaagctgttacagataatacaacaaaacagcttatcaatagcgttttggcttttgacatgcataagctccttccttacttgtacttatttttaatatgattcatcggaatggatttatacataacaaaatatcgctgaacgcgattgtcagggggatgaataagagatgaaaagccgcgggcttgttcgatttttcttttcgattttagctgtgggcgctcttattacaagcgtcgtgggatttgcactgaagtggggggagtacaaggggttctttctgaattttgaggccggtcagattttctctgttctgatctggtttatcggggtaggcatgattttcagtgtgatcagccagatgggattcttcgtctttctgacggtgcaccggtttgcccttgaaattctcagatcaaactcgctttggaatctgcttcagctgtttatcattctgtttgtcgcttttgatttaatgtacgtcagatttttgtttttcggtgagcgggatgactcgattgcggggtttgtctggctgccgctggctctgcttgccgtcggcctgttgacggcgtatataaaacaaaagcagtcctcaaaaaatacgttcgtttcatcattatttttaatggtcgttattacggcgcttgaatgggttcctgcgctaagagtgaataatgaggactggctttatttgatgctgattccgctgatgggctgcaatgcgtttcagctgttaatgctgccgaagtttgcccagaggtagttatttcacttctgatgacttgacgtcagtatttgcgatcaggtcgccgactgtcacgtttttcagtcctttttgctttaaattgtgaatgatggcggggagcgcttcttcggtctgtgttgctgaatcagaggcgtgcagcaggacaatgtcgccgccttttatatgactgtttacattttcaatgattttatcaggaccgggatttgtccaatcctgcgagttaacgctgtaatgaaccactgaatagcggtactgctgtgcaatggcaagaacctttttattaaattgtccggtcggcgggcggagtaaatgaacattcttcacacccagctttttaaatgcggtctgggcccggaggatgtctttttttatttcattgtcctctaggttggtataattcttatacgcatatcccatgctgccgatttgatgtccgtcttttaccatacgttcaactgtgtccgggtgccgttccgcccaagaagctgacagaaaaaaagtggcgtttttaataccgtttgcttttagcgcgttcagaatcggaaccgctttttcgtcgccccagctgatatcgaatgttaatgcgacttcgcccgctttcgtttccccttttgaaatagccttcgggctgctatcagttaaaaatacaggaagggggacggctctctgtatataaaaaaagctggctgctgcaaatgcggcaatgataataataagcagctgttttatccttctgatgtgccacacgtagaagtggttcactgatgacgcctccttatcttgtccatgcttgattacatcgtatgccgcggcggagatgaatataacgaaatacgtttcaaaaaaaaacgaaaaaaacacttgctaaattcagcgaatgcatggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgattgtttgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccgggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctttttattttatctaccatgtttttgtttatgaagcttataatattccgcagtagctcagtggtagagctatcggctgttaaccgatcggtcgtaggttcgagtcctacctgcggagccattgcttccatagctcagcaggtagagcacttccatggtaaggaagaggtcagcggttcgagcccgcttggaagcttatctaaatacgttgatctgaagcagtttccgcacgttatggaactgttattttttgtttagttcagtaaaaatccgttgctgattgtaccagttaaggtataggtatttagcgcgtcttccgatgaagcctttcttcaaggatgcaaaagagattaacataattaattgttaaacggtattgacttttatcaaaaccttgatataattacttttgtcataatgaacagtataaaataacaatacggtttaccgccatctgaggctgtattctggccatgcattacatttttacttgcggaagtagttcagtggtagaacaccaccttgccaaggtgggggtcgcgggttcgaatcccgtcttccgctccattttatcccaacgggatattgtgaaattaattgcgcccgtagctcaattggatagagcgtttgactacggatcaaaaggttaggggttcgactcctctcgggcgcgccataatattttaaaaaatcgggaagtagctcagcttggtagagcacatggtttgggaccatggggtcgcaggttcgaatcctgtcttcccgaccattctcaagctttaaagataatatactggttttctttttttctcttttttaaaaaaatgcttgatttatagagaagcaccgtggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgattgtttgaaccgcatggttcagacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctgtcttaaaccagttcatgatgaactggtttttttatatgaaagatcacatagatatataaagctaatgcctttcaagggcattagcttttttgtttacattgattttgctttgctgttgtgattttgaagattgtttgattttattgtctcgagtattcttaaactgaacacaatcagcagcataaggaccatcagtgcagtaaacagccagaatgcagtttgtgcgggatattcatctaagctccagccgacggcgatcggaaggagtgaacctcctaatccgtttgaagcgagcagaatactggtagtcgtttctgtctttccgggataaaaatgattcgtgatgattagggctattgcaaacatgcctgccatgaacagccctaaaaagaagcaaagggcaaagccgaaccatacgtttttacttagtgccaatacagtaagagcagccagaccgccaatgcttatgagacgaagataacggtgatatgtcagcttttctgatactgggcctgttaataaccttccgatgatcatccccgtccaatacactgtaactgttatcgttgccaaagagttggggatatcccatttctcagcgaaaatggaagggataaaatgtacaattgaaacttcactgccgccgtaaaagaagaagtaagcccccgccaaggtaataaaaagcaatccgtgtgactgataaccggtgctttcttttttagtgtcagcggaagagacctcttttcggatgagaagctgatcaatactgccgaaactcatctgcttccatgcgattaaaagtgcaaaactggataaccctaatactaaaaaagcaattgtccacatgtggttgttgataagaaagcctgagagcagaggcatgaaaagcgcacctaatccgtaggccacttccatcttgctcatggccacagcctgtctttctttaatagcggtgaggatgatcgtacctacacaggattccaccaatccggcgccaagccccgcgatgctgacgagaagaaagagcagcggccagggcggcaggaaggtgatgaacatttcacagctgatgagtgccatgccaaagataacaacgtttttgcgcccaagctttttcaccatgtaaggcattccgatgacaccgatgagaaagcccatgaactgagagaataccaacacaccgccattactgtagctttgtgaataatgtgtgagtaactcaggcagtacggctcccagaataacaagtgtaaaagcaatcgatccataagaaaaacagcttatccacagcagacgagttttcatcattttatctccttattggtaaaataatatttctctctactcgtatgacatgacgtttttacaaaaaatccaagtattgttactatatcacataactttttctcgtacatcccttatggtaacgttaacaaattgttaacattttttacaagaaagatcgttgacattattttcaataattaatacgataaaaagcgaaattctaataatttcataggggtggtatttgtgggaacgaaggaaatcacgaatccagacagcttgtattacagtgttgacgatgtagtaatggagcgcggagaagggatttacctgtacgatcaagaggggaatgagtacattgattgcgcttctgccacatttaacttgaatttaggatacggtaacaaagaagtcattgatacggttaaagaacaagccgataagctgatccatgtgacatcatcttttcaaacagacaccgtaaataaactggcagaaaaactagtagaaatcgcccccgataatctcacaaaagtacaccctaaagtcagcagcggttccggtgcaaatgaaggagctattaaaatggctcagtattactccggaaaaaccgatgtcatctccttatttcgaagccacctcggacaaacgtatatgacttccgctttgtccggcaactcattcagaaaagaacctttcccgccgcaaatttcttttggccttcaagtccccgatccgtattgcagccgctgtttttataatcagaaacctgattcatgcggtatgctgtgtgtagaaagaattaatgattttattgagtatgcgagcaatggaaaaattgccgccatgattattgaaccgatatccggcaacggtggaaacgtcgttccgcctaaagagtattttaaacagctgagacagctttgtgatgaacacgatatcgccctgatttttgatgaaattcagaccgggttcggacggacgggcaaaatgtttgccgcggaccacttcgatgtgaaacctaatatgatgacggtagcaaaagggctcgggggcacaggcttccaagtcgccgccactctgacggaggacaagtataccgggcttccggggtatacgcactccttcacgtacggctcaaatgtgatggccgccgctgccgcgtgtaaaaccatagatatcatgcagcgtccgggatttttggaaaatgtaacgacggtcggtcattatattatggatcgcttagaaacgatgaaagaggatttcgcatttatttctgaggtaagaggcgtcggtcttatgatcggtgtggaaattgtcaaagagaacaatgaaccggatgtggaattgaccaattatattgccaaacgggcgatggattacgggctgattctccggacatcccgttacgggttcggaaatgtatttaaaatccgtccgcctttaaccattacacttagtgaagccgaagtgctctgctacagacttcgcaagctattggaggaaatcaagtgagagactatatcattgggcttggacaatttgtttatcaaaaggtgaaaaatcaaaaaggcacgctgaaaaaccgactcgtaaacggctattctccgggaggcgacgcccaatttaacatagacgccgctgctgaggaggcggtgctggattatattcaagaaaagggccatccggttgctttttacacggaggatggcggcctgaagctgattggagaagatccgcaatatattttaattgtagatccgatagacggaacgcgtccagccgccgcggggcttgaaatgtcgtgtatttcgattgcgcttgcttcatataagccaaacgcaaagattaaggatatcgaatttgcttttttgcttgaattgaaatcgggcgcttatatgtacggtgatatttacagcgatgtcattcaatttgaggggtatcagggagaattgcccaatttgagcggagtgcgggatattaagaatatgttttggagccttgaatttaacgggcatccggcgaagctgatgacggacgcatacggccatctgattgaccaatcggctaataatggcggggtttttgttttcaacagcgcttcttattcaatttcacgaattatcacggggcaaatggatgcttatgtggatatcggcaatcgtctgctgaaagatgatccgaagctgctttcagattttcagcaggtcgggaacggacaggtgctgcatttgtttccttatgatattgccgcaagcgtctttttggcgaagaaagcgggagtggtcattacggatgcatacggccggtctttggacgaaacgcttctgacagatttaagttatcagaatcagcaatcatgtattgcggcatcaacgaaggagcttcatcaaacattgttagaccaaatccgctggggcagaaaggaagagaaatatgaaggcgttggtctggactcctaatgataagcttgaatatcaagaggtggacgagcctcaaattcggaaatccaatgatgtgaaagtgaaaattttcggcaccggtatatgcggaacggatttaaatgtgctgaaaggaaaaatgaatgcaacccatcatatgattatggggcatgaatcggtgggagcggtcgtggaaatcggaccggacgtgacaaatgtaaaagtcggagaccgcgtcgtgatagatcctacgcagttttgcgggaaatgtcattattgccggagagggctgacgtgttattgcgaaaccttcgaggattggcagctcggaatcggggcgcacggaacgtttgcggaatattacgtgggagaagacaggttcatgtacagaattccggattcaatggaatgggagcgggccacattggttgagcctctctcctgtgtgctgaatgttgtggacaaagcttcgattcagccggaggactcggtcttggttttggggtccggaccgatcggactgcttgtgcaaatgatggtgaaaaaactggcgcgattgacggttgcgactgaaataggcagtttccgaagcgaagcggcgagccggatatcggattatgtctaccaccctgaagcattaaccgtggatgaagtgaaacggattaatcaaggaagaaaatttgatgtgatttttgacgcgatcggcaatcagcttgattgggcttatccttttattgaaaagggaggcagaatcgtgccgatgggctttgatgatacgtatgagatgacagtcaggccgtaccagctgctgtcaaacggcgtaacgattgtgggcacaggtgaagcccgtcagatcatggaggctgcgttagcatgcgcgtccgaccttccgcagctctatgattttattacggaaaagacggaactgaagaattatgaagaagccattgatcatctcatgggcatcgacccggtgacaaaagaaagaaaggatatcagcgcaataaaaacgattcttgtgtctgatccggaacttttataaaagcggaaacggctccagtgagagccgttttcttttcttatttatacggtcttgcacatttctttaaagtttaatatgatactctttgttaaccattcctttcctcaacgacattatactctgagcgtgtcccctttttccccgtaagcttgcctcatattccccagataaaaatcaatgtttccaactgataaggtgcggatttttatagtgaaaaggagtcgttatcatttgaaagattatacgttacagcagcaatggttcggaaatgtccgtaaagacattctggccggtattctggttgctctcgctctgatccctgaggcgatcggattttcaattattgcaggtgtcgatccgatggtcgggctttatgcatcattttgtatcgcgattattatttctatcttcggcggcagaccgggaatgatttcagccgctacgggttcaatggcggttgtcatggtgacattggtggctgattacgggctgcagtatttgtttgcggcaaccattttgacaggtattattcaatttattcttggtgtcagtaagatagcgaaattgatgaaatttattccgcgttcggtcatgatcggatttgtgaatgctttggcgatcttgattttttctgcgcagctgccgcagttcaaaggagcttcatgggtcatgtatgctatgcttgccggatcactggctatcatatatcttttgccgaaggttacgacggctgtgccgtctccgctggtggcgattattgtcatgacgatcattgcggtggtcttccatgcggatgtccgaacggtcggtgatatgggcgggattacaagttcacttccgcatttcttgataccggatgttccgtggacgtttgagacattgcggattattttcccttattcactggcgcttgcattcgtcggattgcttgagtcgttgctgacggcccagatcattgacgaaatgacggatacggatagtgataagaacaaagaaagccgcggacaaggcatcgccaatattgtgaacggatttttcggaggcatggccggatgcgccatgatcggccagtctgtcattaatacgaaagccggaggtcgcggccggttgtcggcttttacggccggagcgtttttaatgtttttaattgccgtattaagcggtatcgtcgtgaaaattccgatggctgcgcttgtggccgtgatggttatggtgtccatcggcacgttcgactggtcatcgattaaaggtttgcggaaagcgccccttactgattcgatcgttatggtgattaccgtcgtgacagtcgttctgacaaatgatttatcgaagggtgttttcgcgggtgtgctgctaagcgcaatcttttttacggcgaaaatttctaagctgaagattgtgtcacattccgaacagaaagatgtccgaacttataaggtcacgggacagatcttttttgcttccgtgtctgaactgatgaatgccatcgtttatgatgaagacgtgaaacggattatcatcgatttgaccgatgcccacgtgtgggatgattcgggagcggcggctcttgagaagattgtcgccaaatgtaaagaatacggaattgaggctgaattaaagggattaaatcagaaaagccgagatttaatgaaacaaatggcatagaatttgtgaagtccggatgaatatatccgggctttttttcggttaaatttggcgatgtgcattgttataatgaatgagacttgaaaaccgtatataggagacttgcatatgatgtggcttcagaagttgaaccaagtgttggggagaatcatgccgcttttgactccgtcaagtgtggcggcgggtgtgctgttatctcagcatatcagctggatggccggcgctgtgccgtggatatttgcatttattacatttacgggcagtctgagtgccaattttcaatcgctgaagcgcagtatcgagaagccgctcccgatgatcatggcattgtttgttctgcatattttcatgcctgtttttgcatggggaagcggccatctgattttcagcggtgaccctttaactgtgacggggctgattatgggtgtggtgatcccgaccggaattacgagtttgatttgggctgcgatgtataagggaaatgtcggattgacgctgtctattatcctggttgataccgtactttctccttttatcgtaccgttaagcctgtctgtcctggccggggcgaatgttcagatggatgtgtggggcatgatgaaagggctggcggagatggtggtgattccgtccatcgcagggatgatggtcaaccagttttccccgccggtaaggactcaggcgataagccggtcattgtctcctttttcaaaaatctgtctgatgattgtcattgccattaacagttcggaaatcgcgccgtatgtcacgcatgtggatatcaaatttgcgggcatcgctggcatggtattttttattgccatgacgggttatgccgtggcttggctgatcggaagactgatgaagcggagccaggatgaaatcgtgtctctgatttatacggggggcatgcgcaatatcagcgccggagctgttctcgccgtgtctttttttccgtctcaagtggcggttccggtcgtcatcgggatgctctttcagcaaatccttgccgctttgttcggctatttgctgagacgctttgaacttaagccggtcgtgatcaagtatgaaaaaaaccgctcagctacgtgagcggttttttccgtacagccagcttagtgctgaattgaattgtcgtttgaacgcttcttgatggtgcacggcaccctcttcgatcgtaaatgagagctgagattgagaaaagcctttttgcctcaggcttttgtacacgcctttattttgtccgatcatggtgttttggatgttacatttttgctctgcttcacggctgccgacagacatatagatacgccgccgtgccggccgcaaaggtgcggagcggacataatctgctgatttttcataccagaaggaaccggaaatacagccgattctgccgaatatttcaggcttttgcagcatcgcgtatatcgaaaacagtccgcctaatgacgcgccgatcagtcctctcgtttccgaatgtgcagaaatgtgatgcatatcttcaacagttggaatgatgacatttgtcagctcctcaagaaagagcctccctttgccgccgaaatcatgaaacgcagggctcagggaaggcgcgggccacggtgtgtactcatcgagtctgtcagccggtttgatgccgatgaaaatcaattcggaaagtgttccgtctgcaaattggaattcaagcttatctatctgttctaaaaacaaagatcctccgtcaagtacgtacacacagggtaaagcccccgtttgaaccgaataggacggaggaagatacacagtgcattcccttccgtttatccggtgttctgtaagggtgcctctcatgcgtccagccccttcttttgcttaaacagaagaaaaaagaaataaggaacgccgagaatcgcaagaataattcccgccggcacttctgaaggctgaaagaacaatttgcccgcaaagtcggcggatatgacgaggagcataccgaccagtccgctgaccggtaatgagtatctgtgctcaatgccggcgagcctgcgggaaatatggggcgcgatcagtccgacaaatgccatgctgcccgctgcggttacacatgcgctgatcaaagcgatgcaggcaatgagtaaaatggttttttctttattggttgaaacaccgaggcttttcaccgtgtcctcatcgaaacgaatggtatccagcaatgacgttttcgccataagaagaggaatgaacaagatcagccacggaaggattgccgtaatggtcatccagtttgccgaccagatgctgccgtttttccaaaccatcgccatctcataatcctgcgggtccatttttaatgatagaaataaagacagcgcgctgaatccggaattcatggcgattccgacgagaataattctgcccgattccagatgcccccggtgccaggcgaaaatatagatcagcacggccgccatcaatcctccgatgaggccgaagacaggcatacccatcgcagaggcaagtgccgtcgcttcagattgtccctgaaacagaagcataaacgtgacgattcccgctccggctcctgcattaatgcccaaaataccgggatcggcaagaccgtttttggtaatggcctgaataacggctccggctatccccaatccgagtccgatggcagcagccatgactatgcgcggcagcctcagctgaaacagcaaaatgtcatattgcggattcggatggatgcggaaaagcgtactgagcagttcacccggctttgcggaaaaagaaccgcttgtcatgctgaaatagcttacgagcaatatgagagcaatcagaatgatataaattccggccattttacgcaccacgctgatcccctccttttcttttaatcaaataaagaaagaaaggaacaccgatgatagaagtgacgacttcaataggcgtctcaaacgggtaattgatgaatcggctggcaagatcgcaaagggtcaggaagacgccgccgatgatgcacgcgcatgggatcagcctgctgtagtccgatccgacgagaaaacgtgtgatgtgcggaacgaccaaaccgacaaaggcaatttttccggcgagcgccaccgagcttccggtcaatatgacaacggctgccatcgccatgagtttgatggttcttttctgctgtcccagactttttgaaatgtcgtctcctaatgatacggcagtgacctttttgctgagaatcatggccgtgatgattccgatcgcaaaaaatgggacggccagtttcaaaaaatcagggttcatttgatgcagtctcgcactgtaccaaaaactgagatcctgcgaaatttgaaaataaatcgaaagcgcagccgacagactgctgagaagcatactggttaccgttccgataatggcaagctgcacaggggtaaaaccgccgggaagaatggaggccagcccgaaaacaagagccgcgccgaatgcggaaccgataaacgagtatatgatcatttcaatggatgtcgattgagggagcaataccatgcaaagggtgatgataaaagcggagccgtccgacacacccatgatcgaaggcgaggccagatagttccgtgtgattccctgcatgagcgccccggaaacagcaagggcggcgccgataaacatagcgccggcagccctcgggattcttgaatgccatatgatctgatggtcggtattctccggattaaagtgcagcaatgcggagaacacggtatggaagtcaagctgctttgcgccgtataaaacggaaaggagcagtgacagaacaatggcaatcggtgaagcaatgataataatgtgtgtccgccgttttgcatacatgtgaaaaacctactctttattagtcttgagtcaatttgtcagccgcaacctgtaagaagctgattttactccacgcggttccgccttgggctaatggatcaatcgtattgacgtatacatggtcttttttgactgccttcaggctcttccagatcggatttttctctaagtctttcaaagcgtccggcttatctgcgttttcgtcatcagaaaattgtacgaagatatggtcagggttcatttcgcttaatttttcaagagagatcagttcctgcgctttcgccgctttgacttcgtccggtgccttcaggcctaaatcaccgtaaagcgtggagttgaaataaacttgttcaggataaatataaatattgccttgtctgattctgatgaccagtgcgtttgactgtttcgctttgctgttgatctttgtttttgtctttttcaggtcctgttcgtaatctgcgatgatttttttcgcttttttctctttatctgtaagctgggcgagcagcatcatgttttctttccagtttgatgagatatgagagacagggatggtttcagcggtgccgctcaattttttcaacgttttttccgggaatttggttgatgccagaatgacgtccggctgcagctcaagaattttttccatattcggctgcattttttctcccgttgatacggatttatctgtaatatctttaaacagttccgggaatttgccggagaaagaaattgctcctgccggatgaacgtcaagcaatttggcgtcttccattgattctacgctgcctgtaatggcgattttgtcagtcggcgctttgacttcatatgtttttccgagatattcgattttctgtttatctgaagaagcgtcctttcctttacttgctgtatcagatgtttctgagcttccgcaagccgcggccgtgaaagccaaaagcaaaatcatgaaagcgaatgccaatttcttcatctattgttcctcctgttcaattgataactattatcaattggaattatagagaatgaacagggataagaccatggataatttccggcattaccatggacgatcttcggataaaatggaaatgctttgctcgatcatccgctgatgtccgcttggagaatattcaatccacgggtcagatgaaatgggaaacacgcgtttattgctgacggcactaaggttctgccatatcccggtctgctgaatccgctgaaaatagcgaagcgtttccggttctttacaagtgaaaagcatgatgcagtcagcctggcaatccgccagcatttccaaggaaatcttttcgtcaggagcaaaagattccggttttgcggaggcaaagtctaaatcaccgaagaagacttcctcaatactgttgttatgggcgatgtacatattttctttatatacacggacaaataagaaccgctgatgccgcacgtgtttaagagcatctttcgctgaatgggcgagactttgataagttttaagccagtgccgcgcctcctgctcttcattcagatatgcggctgtgcgaagaaactggtctctccaattctcttgagccggaagataaaaaacttcagtgatgtcattcaggcgctgtttttcttcttcactgacagaatcgagactgaaaatgatgtccggggcagcttgagacagcgtgtgcaggttctcttcccaatttgcattatagcggtaagcgctcaggtgaaccggaatatcggaagagaattgtttgtaataataggccgtccatttcgggtgcagcgctgcagcgtaaggcacgtgatgcagaggaatcagatgccccatcgtttcttttccgtacgcggccatttttgttcgtctttttttcatatagcttgtaggtgagctgccggtatgttttttaaagatgcggctgaaataaaattcgtcctggtagccgatttgatgagcgatttcccgcagtttgcagcttgccttggccatcagttttttcgcattggttatgcggatgtctgtgatatattcagttacgctctgcccgtatagttttttaaaggtttcactgtaatgcttgggactgattcccgccatatgagcgagctgggtgagtgtgatttttgtgtcggactgagcatgtatgaattgttttgtctgttcgatcgccgctttcgtattattttgatggcatacttttgcggcataaaggtcgtacatcagctgctgaaagtcggctgtatatttcattttctgcaatccatccgccgatcgcacgttttcagaaagtgattggagccggcttgtcaaatgatcaaccgtttgtaaattcatttgctgaagtccgtggaagatgtcttccccgttatccggaagcatcgcttcatcatctgaggaataggagaaaacacggagtctgacgatatacaaatggatgccgcctgacgatataggggcaatattgaatgtctcatcacaaggacagatgtagagcgtttccttctgcagcggaaagctgtctgtgccgatatcaatttgtccctcgcctttcacatgaaagatcaatacgggggaatcagtgagctgatgctctgacagaaggtcggctgttttttttacggagatgatatcaacgggctgaaagaataatgtgtttttcatgagaaaccaccttttaggaaacattcatttaaatgataactgttatcaattgaattgtaccaaataaatgaatgttttcctataaaaagcggaaatgtgaaatgcgacaaaatgttacacgtgtaacacgaatgttgtcagtatatgaggtattgttttcttagagttttgaattggtccagccggcgttgatatgtgccggtgatgtcttcaatggaagcgcctttttctatttttttgcgtacccagccgttaccgatcagcttgtcaaaagagcctgtcggcaagaatgaaaagtcattcggatataagtcatgcatggttttcagaatcgagagccctgttttggccgcttcaaatgtgtttctgtttgttacgtagacttgtacgccgtggcacagcttgccctggtgcttggagaagctggggatgaatgaagcggctctgaaggtgacgcccggaagcttgagactgttcaggcgttcttcgagctcggtgcttttcatataaggcgcgccgataagttcaaacggctttgtcgtgccccttccttcggacacgtttgtgccttcgattagtcctgtcgccgaatatgcgaatatgctgtccggggtcgggatattaggcgaagggaggacgaacggcagaccggtatcttcaatcgtcatcgtccgcttccagcgcttcatttttacgacggtgaggtcagcgccaatatgaaactctttattgaataaaagagcaagctcaccgatcgtcatgccgtgcttcagcgggatcggatacagtccgacaaatgaagcgtaatccggttcaagaaccgggccgtccggatttcgtccgccttgcggattcggccggtccaagacataaaaaggaatgcctttttctttggccgcttccatggcataggccattgtataaatgtaggtgtagtaccgggttccgacatcctgaatatcgaaaatcagcacatctgtatctttcagcatgtcaggcgtcggtttcctcgtctccccgtataggctgtagacgggaagccctgttttttcgtctatataggatgtgactttgtctccggcctgagcatcgccgcggacaccgtgctcgggtccgaataatgccgtcaagtggatgtctggcgcctcatacagcacgtcaacgctgcttttcaatgatgcgttcacaccggtcgggttggtgatcagcccgaccctttttcccttcagttcctgtttataatctttcagcaggcggtcgatccctgtttgggtgcttggtttcttggcggtatgaagggttctgtcagaagccgccgagactgccgtcatagcactgatgacgacaagtccggcgagaagtgcagccgtatgtgttttcataatcagccctcctgtttaaagcggttttcctgtcttcagattgataccgaaaccataaggatacagtgtcgttcccggatgcgtgacggaaggaatgtcagcgggcagcctgccttgcggtgttgtctgtccgaatatcgcttcaatgcctgccggaatgtttggctggaggaattgtccgtctgtatatcctttaaagccgtagactgcgataagggcttcagcttcttcaaaattcgcggcgtcgtaaggattacgcaggctcatcagcacaaagggtttttggttcgattgtgcggctttcatgacggcccgcggaaatgcagtcgcccacttgccgggatctgtgacggaatcgtcaatcacgccgtcgtttacgacagggtcattttttacgacataggagcctgtaatcacgtaatccgcatcagataccagctttttgtgttcatcatgaaatgtgcgctcggcgaagttcattttactgatggttaccggccggatttttttcttcttgatgagctgccggatggtttgttccattgacgctgtttgatcttcataaggagcggcaatgagaacgcggctgttctttttcggtttgaatgggagcgtgcggtttttgttttgtaagacggtgacggatctttccgcgatttgtttttcagttttcaggtgatttttactgccgacggttttctttgcttttgcaatcttctttttcagatttgtctctttcggtgcgggatatatccctcgttttattttcagggaaatgatgcgttccgctgatttgttaatttgctgcagcggaatatcccctttttgtaccgccttttttaaagcggaatgaacccgggcaaagcggttttccgtttgcagcgatgtcacttgggccggcatcagggcaatatcgactcctgcttttactgccatgacgaccgcctcttcctgaccgaaatgatcggcaatggctttcatatttaatgcatccgtaacgatgacgccgttaaatcccatttcctcacggagaagatgagtcatcacttttttcgagagtgtggcgggtacgaggatgtctgaaccgtccagcttgcttttataggttgtatcgtcaaaagcgggaaattgcacatgggctgtcatgatcatatcagctccggcctgaatggcctgccggaacggataaagttcaatctgacgcagcctttcttgattgtgggtgacaagcggaagaccgtagtggctgtcgacatccgtgtcgccgtgtcccgggaaatgtttgacggcggcagcgacattctgcttttgctgagccttcattgaggcaaggccgagtgaagctgtcagatctcggtctgaactgaacgacctgacgccgatgacagggtttgcgggattattattgatatcgagaacgggcgcgaaattcgtattaatgcccagtgctttcagttctttcccgataatggcgccggtctgggacgcgtaggctgtttttctagcagccccgagtgccatattgcctgggaaatgagtgccctcaccaagtctagttacgatgccgccctcctgatcaatgcttaataatagcggaatgtcagggctcgccttttgaaaagcatctgtcaggcgtaccgtttgctcagtgttttttacattttctgcaaataagataacgccgccgaaccggtacttttgaataagccttgcgacttcgtcattcatttgggtaagagcctcaggtgatgactgcccctttttttgccaattacgaaaatcaggcatgagcatctgccctaatttttcatctaatgtcatacgggataccgcttgttccgcctgtgacggaatatccggttttgtcgatgcatgatgcgtgccgaaaacaataaacaacagtaatacagctgagatgaaaagtttcataatggtgccctcctgccgtcatagtttggacaaaagacatgggttgtcattcaatggcttcataaatcgcttttatgacgctgccgtagcttccggtcgggaaaagatccccttcaaaaacattcgggttttcaccggggctgacgacgggggaatgctttttattggtcaaaagtgcgatccccagcttataagcgggatcaataatcgtgatggtgccggtccatcccgtatggccgtatgcctgcctgcttgcataaggtccgaacatccactccatatccgggctgccgtttttccgccagccgagagcgaatgtcggatcagaggatgccgcggttgtgaacaaatcggccgttcttttattgaagagagaaacatgtttataactgccgccgttcagcatgacttgaagaaggacggccaaatcatcagctctggaaaacagcccggcgtgaccggacacccctcccattgagtaaaatgctttttcatcgtgaacttccccctgcagcgtatacgtcctgatgtgagggaaatggatgactccgtcacgtgtgttgcctaaacgttcagtagctgcgaatgctttttctttaaaacctttttgcagcggattgaacagtgtgtgcgtcagtttcagcggtttgtacagttcttgttccgcataggtatcaagggttttcccggttatgttttcaataaggcagccgagaagcatgtaaccgatatcgctgtatacgtgttttgttcccggcttgtattcaagcgggatttgggtgagaaaacggatcgttttatcccgttcttgtgaatataaagggcctgcggtgtccggctgatagaaataaaagcttgccggcagaccggattgatgctggagcacatcgataacgcgtatgcggtcttttccttgaatcggatcgctttttctgtctttgaaatcaggaaggtaagccgagactttttgatacacatcaagctttccctggctgacgagtcgctgtagtgcaaaattggccgcgtacatttttgtattggaagctaaatcaaacatggttgatgttttcatttttttcggacgggataaaagggtgttcccgtcatattttttgctgtagccgtatgctttctttttgatcacccgtccgtcctttacgacgacgaggacggctccggggaatcctgctgcgatgtctttttcaatcatttgatcaacctttctgagctttgctgcgtcgtataatttggattgggcttcggctttgtgctgcggcagaaaagagaggctcatgaccattgtgagtatggcggctgtcagtgttttcatattctgatccctcccggtttattcaaattcagcagccatgtcatccttaaatccgaacgcataagtgaagacaaagcccgccgcgtaagagatgaagagaccgatgatatacaaaacgatttgagccggctgtacgagaaacgagagcggaaggccggagacaccgattgaaaaagtagccacttgaaaatgggcttgaaaggcgccgccgattcccgcccctaaacacgccgtcaaaaacggccggccgagcgggagcgtgacgccgaagatgagcggctctccgattccgagcagaccggatggaagtccgccgccgatcgctctttttaatgaggctttttttgttttcataaagatggcgaaggccgcgcctacttgacccgcgcctcccatcgcgagaatcggaagaagcgggtcatctccgattgatcggattaattccaaatgtacgggagtcaagccctgatgcaggccggtgacgacaagcggcaggaaggcggctcccagtacaaaccctgagagcactcccccgacattcagcagcgacaataaacctgatgtaatcagatcagaaataaaaccgcctgcagggataaaaacgacatatgtcaccagcccggtgataagtaaagacaatgtaggcgtgacgataatgtcgatggattgatggacgtactttctgataaaccgttcggtataagcgataaaaaccgcagcgaaaagaacgccgattaatcctcccctgccagggagtagattctctccgaacaaactgatattggcgatctcagggttaaggatcaatatgcccgcaaggccgcccatcgcgggtgtcccgccgaattccttcgccgcattgatgccgacaaggacgccgaggtaagcgaacaagcctgaaccgataaccgttaaaataagtgcgatttgagattctttcgggagccagccggcctgaatgacggctttcgtaataccggtgattaaacctgatgcgatgagtgcgggaataaggggaatgaagatgcttgatatttttctcagaaacaatttgatgggtgtggtgttttttctgttgagatcggcttttttccgtgaggcggcttcttttaaatcaatgttttttccggatggcattagttttgcgaaagcgtcggcgacatgattgacgacacccgtgccgagaatgatctgcagtgtttcggcttcgacgacgcctattaccccgtcaagccgtttcagcgcctcaatatccgttttgtcccgatctaaaggtgtaatcctcaggcgtgtcatacagtgggtaaagcctgaaatattcgatgaaccgccgcaattgtccaggatatctttggccagtgactgataaaatgcctctttgctcatggagatcctcctttttccgtacgatttttcccggggagctatgcctgaaacgcgtcctaaaagcgcctgcgccgaacatgaaaacggcgcgggctcgtaaaagcacattatttttcaccaaagaacgatcagcgttctttttctcttgaaacgtgctgttcaatggctttatcaatgaatccttctgattctttgagcagtgccttcgcgtgtgtttcgtccgaattcgtcttcagcatgacgattgccgttttgacatggctgcctgcggcctcaagcgtttcttttgccttgtcgtacggaacgccagtgacgctttggataatgccgatggcgcgttctttcaatttttcgttgctgacatgaacgtccaccattaaattttcgtacactttgccgcttttaatcatcacggccgtggaaatcatgttcagaatcattttatgtgccgtcgcggctttcattcgtgttgaccctgtaatcacttcggggccgacaatgacttcaatgctgtgatcggcaaaggtgctgatcaatgagtccttattgcatgtgagcgcgacggttttggcgccgattgtttttgcatatttcagcgcaccggccgcatacggcgtgcgcccgcttgccgcgatggcgatcacggtgtcttctgcggtaagcccgatcgttttgagatcgagagcgccggtttcctcgctgtcttctataccttcagccgcttgcaaaaaggcgtctgcccctccggccatcagaccgatgacggtgtcgggacttacgctgtatgtaggcgggcattcaactgcatccagtacaccgagtctgccgcttgtgcccgctcccgcataaatcagcctgccgtttcgccgtaaggactgatgggcgaattgaacggcaatctgaatatcgggcagcacctgctgaacggcttcagccactttgaaatcctcttcgttaatgatacggagaatttccatcgtgtctgcctgatggattgaagcggtctgcggatttctggtttctgtggtcaatctgtgaatgttaagccggtctgtcatgatcgtaccctcccaagtcgttaatacttgaagtatatgggcatctgaatagatgtttcaagaaaaatcggcagggatgagatgaataatcaagcgctttcacaaaaaatgatgcagaatgtgctgttcaccgatcgggccgatcctgcgccgccctttgtcaataaaaccggaagaccggtacaggttctttgcacgttgattgcgatggtttacagcaagcacgatttcatcacaccaaggaaaataatttgcgacaaaagcggggagctgcagcatcgcttgtttggcataaccttttccctgatgcggcgcatgtaatgacagcgcactcagcaaaatggcagacacattgttcgaatacggggcaatggtttcttttgaggtatgtaaaataaaaaaaccgacggggcggtcttcttttaaaatgactgtcgggtagcgatcccggatgacaagcgcctgcggcaggacatctatcggcagagctgtgaactttttatcttcttcactcagcacaaacccgttcagcccgtctgcatgctccggtttataaaaggacagggctacatccatgatatctactctccttttttataattgatccaattcatcttctgatagaacacggcagcctgcccgttttaaaagagcggaagtgatgccgtctccgagtattttttttcctgagaaagtgccgtcatagataaagctgctgccgcaggacggactgttttctttaaggatgaccgttgcggcgcctatttcttttgcgtatgctaacgttttttccgcgccgtccatatataaagctgtaacgtcttcgcctgatcccgttacgattcttgccgttccgttcagcacgtcttcacccgtgccgccgatgatttccgccggttcgcggggagtggtgaagccgcccaaaagttcggggcagaccataacagctttcttttcttctacgagtctgcggattttttccgaagcggcgtgagagccgttatatctgcattcgataccgccgagacaagagctgactaagatcatctgtgtccattcccttcaatattttgatactttcatcataaatgaaataagagaggagggatgagtttttcagttaaaaaacgggtaaaaaagtttgaaaataaaaaaaataatttttctctttacaaatggggtacaacctgtatataataacttttgtcagctcgacgcggacacaacggcccgttggtcaagcggttaagacaccgccctttcacggcggtaacacgggttcgaatcccgtacgggtcatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcactgttttccaaaaaaatacggaggggtagcgaagtggctaaacgcggcggactgtaaatccgctccctcagggttcggcagttcgaatctgcccccctccaccatttttgggctatagccaagcggtaaggcaacggactttgactccgtcatgcgttggttcgaatccagctagcccagtctcagacaccttttgcataaaggtgtcttttttttatcagcattttgtttcgatttttgattgttcatcagatatactatttttaagctgctgttaaggcagtatattctgtattttccatctacaccctgcctgaaatttggtaaaataaatgtaataaaaaaaatgaaaccttttaaaacaatcaacgtatagatacagaccggtgaagggcagaggtaagataaaacatggaaaacctgattaaaaaaagaatcaagcaagtcaaaaaaggcgatcaaaatgcgtttgcagaaatcgttgacctttataaagataagatttaccagctttgctaccgcatgctcggcaatgttcacgaagcggaagatattgcgcaggaagcttttatcagagcgtatgtcaatatcgacagtttcgatatcaacagaaagttttcaacgtggctttacagaattgcgaccaacctgaccattgaccgcatccgcaagaaaaagcctgattactatctggacgcagaagtagcgggagcagaagggctgacgatgtattcgcagatcgccgcggacggggttctccctgaagacgccgtattgtcattggagctgtcggacacaattcagaaaaagattttaaagctgccggacaagtacagaacagttattgtattaaagtatattgacgaactctctttaattgaaatcggggagattctgaatatccctgtcggcaccgtcaagacaaggatacacagaggcagagaggctcttagaaaacaattgagggatctttaagtggggtgatgaaatgagctgtcctgaacagattgtgcagcttatgcataagcatcttgatggagatatccttcctgaagatgaaaacgtattaaaacaacatttgcagtcatgcgggaattgcaaacggcattttcatgaaatggagaaatccgtagcactcgtccgaagcacatcgcatgtcacggcccctgctgattttactgccaaagttatggcgaatcttccaaaagagaaaaaacgcgcttctgtaaaacgatggatcaaaactcatccgatgattgcagccgcagcggtttttgtgattttaatgggcggcggttttttcaacagctggcataatgaccacaatttcagtgtgtccaaacagccgaaccttatcgtgcagaatcacacggtcaccgtccctgaaggcgagaccgtaaagggcgatgtcacagtaaaaaacggcaagctgttcattgaaggaaaagtcgacggcaatgtgaccgtcgtcaacggagaaaaatacatggcctcagccggacaagtcaccgggcagattgaagagattaaccaattgtttgactgggtctggtacgaactgaaatcggcgggccagggcgtcgtgagcgctttggacccgaatgaagatgagtaaagcgtataatcgctttactcttttttttatgcatcgccgtgctggcccatttcacttgagaaatcaaaatgtgttataatgagcacgctatatgatgtacatattgctcatgcagcacaattcataacggaaaaaacgaaatgactgaattcttggaggacgaggaaatggcttttgaggacatcccatttttgcaatacctcggcaatgccgttgatattctccttgtttggtatgtgatatataaattaatcatggtcatacgcgggacgaaggcggttcagcttttaaaaggaatcgtcgtcatcgtattggtccggatggccagttcatatttgggactcagcacgcttcagtggctgatggaccaagcgataacatggggatttttagcgatcatcattatattccagcctgagctgagacgggcgcttgaacagctcggacggggccggttcttttccaggagcggaacccccgtggaagaagcgcagcataagacaattgaagcgattacaaaatcgatcagctacatggcgaaacgccgcatcggcgcactcatcgccgttgagcgcgatacgggaatgggcgattatattgagacgggcatcccgcttaatgcgcaggtcagctcggagcttttgattaatatcttcatcccgaatacaccgctgcatgatggagcggtcattatgaaaaataacgagattgcggcggcagcctgttatctgccgctttctgaaagcccgtttatttcaaaggagctggggacgcgtcacagagcggctgtcggcatcagtgaagtgacggacagcttaaccattattgtgtctgaagagacgggcgccatcagtgtggccaaaaacggagaccttcacagagaattgacggaagaagaactgaaagaaatgcttgaagccgagtttaagaagaacgccagagacacttcttctaaccgctggtactggaggggcaagaaaaatggataaattcttaaacaaccgctgggctgtaaagatcattgcattgctcttggcgctgctgctttacgttgcggttaacaacaaccaggcgccgactccgaaaaagccgggggaatccttttttccgacatcaacgactgacgaggctacgcttactgatattcctgtaaaagcatactacgatgaagcgaactatgtcgtcaccggcgtgccccagacggtaaatgtcacgattaaaggctcgacaagcgcggtgaaaaaggcgagacagacgaagaattttgagatatacgccgatatgaataagctgaagaccgggactcataaggtcgaattgaaggcgaaaaacgtatcggacggactgacgatctccattaacccatcagtcacgacggttacgattcaggaaaaaacggctgagagttttcccgtggaagttgaatactacaataaaagcaaaatgaaaaagggatatacccctcagcagccgattatcagcccgaaaaacgtgcagattacaggttcgaaaaatgtgattgataacatttcacttgtcaaagcatccgtgaaccttgaaaatgcaaatgagaccattgaaaaggaagtgaaggtgaccgtctatgacaaagacggcaacgcacttcctgttgatgttgaaccgtcagtcattaaagtgacggttcccgtagccagtccgagcaaaaagcttcctttcaaaatcgaaagaaagggaagtcttccggacggggtgagtgttgcgagcattgactcgaatccgagtgaggtgacggtttacggcccgcaggatgtgctggattcactggaatttattgacggcgtatctcttgatttaggcaaaattgataaagataccgatatcaatgccgatatcccgcttcctaagggtgtcactaaggtatcaccggaaaaaatcacgcttcatgttaaagtggacagtgaagacaaaaaggattttgacaatgtcgcaatcaagacggtcggactgggaggctcacagcagattgagtttctcgaccctgaatcgcaggcgataaatattacggccaaaggctctcccgccaacattaaggcgctgaaaaagtcggacattgaactgtatgccaatgtctcggacctggatgacggagagcactctgtaaagcttgaagtaaacggcccgcaaaacgtcacatggtccctgtcaaaagacacggttaagatcaagctaacttctaggaaaaacacaagttcaaataaaaatgacggcggctccgctgattccggcaataataacggcacaagcggagacgcagacaaagacaagaacaagaaccgggaagacgacactgacagcgatcagaataaaagtcaaaaccaggatcaaaatcaagaccaggatgaagacggatcaagcgctgattcttcttcaacagaatgaaaaaggagcgatacaaaatgggcaagtattttggaacagatggtgtaagaggtgttgccaacagcgagcttacgccagagctggcctttaaagtggggcgttttggcggttatgtcctgaccaaagataagcagcgcccgaaagtgctgatcggccgtgatacacgtatctccggacatatgctggagggagcccttgtcgccggacttttatcgatcggagctgaagtgatgcgcctcggcgttatttctacgccgggggtatcctatttaacgaaagccatggatgctgaggcgggcgtcatgatctctgcttctcacaaccccgtacaggataacggaattaaatttttcggaggggacggctttaagctttctgatgagcaggaggccgagattgaacgtctcatggatgaaccggaagataagctgccgagaccgacaggcgcggacctcgggcttgtgaacgattattttgaaggcgttcaaaagtatctgcaatttttaaagcagacggcggacgaagattttacgggcattcatgtagcgcttgactgcgcccatggtgcgacatcttccattgcgacgcacctttttgccgatctcgatgctgacgtatctacaatggggacgtctccgaacggattaaacattaatgatggcgtcggttctacacacccggaagcgctgagtgctttcgtcaaagaaaaaaacgccgatatcggccttgcgtttgacggagacggcgaccgcctcattgccgttgatgaaaaaggaaacatcgtcgacggcgatcagatcatgtacatatgcgcgaagtatttgaaatcagaaggccgtctgaaggatgataccgtcgtatcgaccgtgatgagcaacctcggtttctacaaagcgcttgaaaaagaagaaatcaaaagcgttcaaacggcagtcggcgaccgctatgtcgtagaagcgatgaaaaaagacggctataatgtcggcggcgagcagtcagggcaccttattttccttgattacaacactaccggcgacggtcttttgtccgcgatcatgcttgtgaatacgctgaaggcgtccggcaaaaccctttcagaacttgcggatgaaatgaaaaaattcccgcagctcttagtgaacgtgaaagtgacggataaatataaggtagaagaaaacgctaaggtgaaggccgttatttctgaagtggaaaaagaaatgaacggagacggccggattttagtgcgcccgtcaggcaccgaaccgctcgtacgcgtgatggcggaagcgagaacaaaagagctttgtgacgaatatgtcacaaaaatcgtggatgtcgtgcggacagaaatgggagcggagtagcgaagtttataagcagagagcgaacaagacaagtgcgatcagcataaaatgatagtaaacatgatgccggggcggcaaaaaataattgaccgtccttggcacatgctgtaaaatcaagcttgttcagcctttgtttttcacttgcaggaaaggcgggattgtttgcatcttttataattacagcgcccgaactaagcgcccgaaaaacggcttagttgacgaggatggaggttatcgaattttcggcggatgcctcccggctgattcatttagatcacagccgtaaggatttcttcaaaccggaggggcgactctccgaacaaagagaaatcacatgatcttccaaaaaaacatgtgggaggggacgattgaaagtccccttgtaatttgactttcttcgtctccttttacacctttaggaggaagaaaatatgtgtggaattgtaggttacatcggtcagcttgatgcgaaagagattttgttaaaaggattagagaagctggagtaccgcggctatgactctgccggtatcgctgtggcgaatgagcagggcgtgcatgtgtacaaagaaaaaggccgcatcgccgaccttcgtgaagtggtggatcacacggttgaatctcaagcgggaatcggccatacacgctgggcgactcacggcgaaccaagcttcctgaacgctcacccgcatcaaagcgcactcggccgctttacacttgttcataacggtgtgatcgagaactatgttcagctgaagcgcgagtatcttgaaaacgttgaactgaaaagcgacacggacactgaagtagtcgttcaaatgattgagcaatttgtggcgggaggactcagcacagaagaagcgttccgtaaaacactgactctgttaaaaggctcttacgcaattgcattatttgacggtgaaaacacagacaccatttacgttgcaaaaaacaaaagccctctgttaatcggtcttggagatacgtttaacgtcgtggcatctgacgcgatggctatgcttcaagtaacgaatgaatacgttgagcttttggacaaagaaatggtgatcgtgacaaaagacgaagccgtgattaaaaaccttgacggtgaagtcatgacacgtgcgtcttatatcgctgagcttgacgccagtgatatcgaaaaaggcacataccctcactacatgttaaaagaaacggatgagcagccgcttgttatgcgcaaaatcatccaaacgtatcaggacgaaaacggcagactggccgtggcgggcgatgtcgctgacgccgtggcggaagcggaccgcatttatatcgtggcttgcggaacgagctaccacgccggtcttgtcgggaaacaatatattgaaatgtgggcaaacgtaccggttgaagtgcatgtagcgagtgaattctcttacaacatgccgcttctgtctaagaagccgctctttatcttcctttctcaaagcggagaaacagcggacagccgcgcggtgcttgttcaagtcaaagcgctgggtcacaaagcgctgacgattacaaacgtcccgggatcaacgctttcccgtgaagcggattacacattgcttctgcacgcaggccctgagatcgccgtggcatcaacaaaagcgtatacggctcagattgccgtcctcgcgatccttgcatcagttgcggcagaacgcaacggcgttgatatcggttttgatttagtcaaagaattaggtatcgcggcaaacgccatggaagccctctgcgaccagaaggatgaaatggaaatgatcgcgcgtgagtacctgactgtttcaagaaacgctttcttcatcggccgcggccttgactacttcgtatgtgtcgaaggcgccctgaagctgaaagagatttcttacatccaggcggaaggcttcgccggcggcgagctgaagcatggaacaattgcactgattgaagaaggaacaccggtctttgcgcttgcgacacaagaacacgtcaacctgagcatccgcggaaacgtgaaggaagtcgcagcccgcggcgccaacacttgcatcatctcgctgaaaggcttagaagacgcagacgacagattcatcctgccggaagtcaaccctgcgcttgctccgctggtatctgttgtgccattgcagctgatcgcttactacgctgcactgcaccgcggctgtgacgttgataaaccgcgcaaccttgcgaagagtgttacggtggaataatatatttaacccctttggttattagccagaggggttttttaatgcggaaatgagaaatacatactctttgcgattgtaaagaaatccccttttatatattgaaaaggaataacacctgctttataatacgagatgcattccggttaacatccataaatgtaatcattagtaaatcatttttgtgtatgtctcatcgaaaagtaatcacctccagtaattttcatcatgaatatccattatataaatgtaatcaatcgattacacttccaaattatgattaaaaaagactttaaaatcccttttgtatttgccgactcctgatccattatgaatacctagactagatatgaaaatcacaacatttttgcaataatccggttcaattcttaaaaaagtcctgacaacaatgataggagtggaatgatgtcaaatcttttagaaatcagaaacatcagcaaatcttttggtcataaagctgttttaaaggatgttacattcaatgtgcctgccggatcaattgtcggttttatcggtgataacggcgcaggcaaatcaacaacatttaaaacgatattagggttaatctctcaagatagaggaaaagtgaaaatctttggtgaggagaatctggataaacatataaagtttaaagaagatattggggtcgtatttgatgcgatgaatctgcccgcgcaccttacgataaagcagctgaaccatgtatttaagaaactattcgacgcttgggaccaagaccatttttaccggttggttcattctttctctttacctatggacaaaaaagtgaatacattctcgcgcggcatgtcaatgaagttatctgtagctgttgctttgtcgcataatgcaaaattattactcctggatgaagcaacgggagggcttgatccttcttcaagagatgatctgttaaatgaattaaaaagctttgtgagtaaaagcaacggcggtattttactttcatcgcacattatgactgatgtcgagaagatagccagccatatcattattatgaaagatggcgaaattttattaaatgaagagaaagataaggttcttgaaagctataccgttatagatgttgatgaaggccaattggctgagcttgacgaagatatcgttctagcaaaaaggaatcatggatcttattggagtgtgcttgtatcggatcaacagaagttgccgaatggcgtaacggccaacaccatttccatagaagaaatcagcgtctttttaacgaggagtgaaaacattgagaggtctgttactgactaactattacttggtttatcggagtttctttgcatacacagggttggccatattggtatcagcagttattttttattttggggatgcttcaatgcatcgttttgttgctatgctgattattttgtttgtcgttatgcccgcacttgaggttataaagtatgagagcaagtctggctatgacaggtatgtcttgactttaccggtcagcagaacaaatattgttcaaagtcactatttcttttatcttttgattgttgtgatcggagccgtaatatcttatggtattttcgttgtatacagcctgggttctgatgaaccaattgacggcatatttaatattgtctcttttggaacgttcatcgttctctttgccggtgcaatcgtttatcctcttctctacatgataggtccggaaaaatccgatgctatcgtgattggaggggcaatggggggactttttgctacctttggattgcaaagtgtcgttgggtatgtagcagaacaagtaccgctgtcatttttgcacataaatccttctttatatgtcccgattatatatctcatgatcggcgttatcttatatatcatttcatttttcatcgccgcagctatatatcataaaaaagaattttagcagcgtgtttaatgttttatgctgtgacaacaggataaggcatggcacgggctcataaattcactttaactccaaggagacagccgcccgcacaatgggcggcagttcttctaattaaaactgcgttgtcatatcgtactcataatcaatcttcaatttcacatttttcatagccgattttgctgttacgagtgtgttgtatttaaaattccagatgcttgagactgagaggttatcttccagtgtgatatcgtaatttccttgagtggagctgtttgcgagtgcgcggtgccacactttattttcttctgacattatgcagtgtcttgtgtttccttgacttggtatttgagtcgcggcggtgctgattcttttcactatggcgtcttttggaatgcttgtctgtttggttaagtcgagcctgagaacagttgaatctgatccattcggactgaggtttgtatttcctttattttcagccgtgccgctgaatgagaaggtctcgcttccggttttgattcgatcgtaaatggagagtgtaaagtatatatcgtcagtgtatgagccgcgggacacttttacgtagaacgtctcgttattctctttcgcatctgtaatggcatagataaaaggaagcggcgtatcagggtttatcacttctgtgcctttactgatcagcactttgtttttattataaatttcaatgctcattcccttgtattcacttcttgttgagctcctgacatagagtctttctcccttatttgccgtgaaagtgaagtacgattctttttccccttccggcaatatggcagtatcaatatttttatatttccagtagcctactggattggcagtttcaaatgagtgatttcctgtaatagcgcttatttgtgatgagttcttttgagacgcagaggctgaaggtgcaatcaatacgcctgataatacgattgcactgacaaatagtatagatatatacttttttatggaaaaatccccctttttgactacatcatacataaaaacccccatgatgtaaacatttgttattttaggttaaaatcaactgggaaacagccgatacaaacactagaacatcatctcaagcggaggttaaaaacatgcgcctaaacgctcgttatataaaaaatcaaataatggctcagcaagcgcttcagcggtatacttccaaaacaaatgtgaaagatgcggcaaaagggccggacagcttattgattcaggcaagcggcacccgcgatctcagccaggtgaattattcaaggagcggtgtcactgagaaagggagcagtctgtcccgtttatatcaatccgcaaatcagaaaacgattacggataatgggaatgagacggtaatagacgctaataatccgtatgagtctgagagtgatattgcgagcaagattcttgatgagaaatacagccgtatcaatgaaatcaataaacgaaaaccagatcctttgcattatattaaggacaaataccagcgtgccgattcaccttatttcagaagtgatttatcagaatcggagcgtcaggctgcttatcataatgaaacggaatggctgtttaaggggaaagcccagagctatgatttccgtgatgcggcgtttcggggtgaaacgctcaacggagagattcaaggagaaaatgaaaaggtgtttcagagagggcaggtcaatcagcaaatcggtgtgctttttcatcggaatcatattcagattccggagggtgcgaatcttacatttacgatatcaccgattgattatctgttaaaagtgagcgggattgacgataaagagctcactcagcagattgaagccgtcttaaactccggggaaaacagcaaagagctgtttgcgcacatcattcgcagccggagtgatgactcctcgcagtttacgccggaagcgtatgagaaatatcaagtcgttcgggaaatgtatgaggtgaccggctatcatctgaaagacttgcagactgtgggtgggaagttcgtcacagaagacggccgcgaccttttagaggtttataaggaagcgctgcagcaagatcctttgctgaaacatacggcggcagaagcggccgcccattacggacaggggctcacgaagcttgcgagaacgggttatgatgccattcctgatttggtgctgtccattgagtataaaaacggatctctgcgtgatgccggtcaaagcaggcaatacggatctggggatacagattggctttctgaatggaaacgggagctgggtgtgcgtatataaaatgagaaaaaagctgacgaatgatgccgtcagcttttctttatgtgttttcttaaaactcctcatactccgccgggtcttggccgtttatgcgtccgtcggggcgggtaagcgagtcgatgatgctcatgtcgttttcatcaagggagaaatcaaaaacagagatgttttcaagctggcgctcgggcgatgctgattttggaatcgggatggcgcccagctggatatgccagcgtaaaatgacttgagaaatggttttgccgtatttgtccgcaatctgtccgagtttttgatcgttcaatacttcgccggcgcgggataacggactccatgattctgtcacgatgccctgttcttcgtgccattggcgctgctgctgctgattaaaagcgggatgcagttcaatttggttgatgcctggctttacgccggtttcacgttcgagccgttcgatgtgctcaggcaggaaattgcagacgccgatggatcggatcaggccccattttttcgcatcaatcagtgcctgccatgcttccgtgtagcggtcttgtttcggattcggccaatggacgagatacaggtcatagtagtccagaccggcgcggtataaagattcttggatggtttgtacagctttgtcatagtcatggtagcgcccgggcagcttggacgtcacgtatagctgttctctcggaacagagcttctgcggatggcttctccgaccgtcccttcattttcatagttataagcggtatcaatcagacggtagccgatatcaatggcgctggtaatggcatgaacgccattgtttccattaagagcgtatgtaccgaagccgatcgcgggaatgcttgtcccatcaagcagtttcttttgcggaattgtcccagtcatcattaaatccctccttgttttctactttaccattattcttacaaatgaaacataataatggaaggaaatgagatgatccgcacatgaaaaaagctgacggagaaccgccggctttaaatttgaaacatccatgctacgacggggccgaagaccgaccctaacacggcgcagagcgtcatggatacagaactcatggagaccgttaattctccgtactccattgcttttgaggtgccgagcgcatgggaggcgctcccgaatgcaattcctttcccgagtgagctgcggatgcggatccacttgagaagcagcggtcctaagataacgccggaaaaccctgcgatcatgacgaacacgactgtcatggaagggacaccgccgataccggacgcaatctgtatggcgacaggcgtcgtaattgattttgggataattgacaaaatcaaactccggctgatgccgaacagctctgcaaatagcaggccgctgaccattccggagaataaaccggccaacacgccgccgatgatcggaaacatatacttgattaacacccggcgctgcttataaagcgggtatgccaaagccaccacggcgggtccgagcagtgaattgatccattgtccgccgatcatatacgctttatacggaatatgaaaaataagcagcacggcgataatgaaaatcgtagtcgtcaaaaccggtatgagaaagggatatggaaagcgcacatataatctcaccatagccagataggcggcggccgtgaacaaaattataacaattgcgatacatgcttgctgcacttctttttctcctttctctgattggctttatgctctaacagctggctggcgtaccctgcggcgatcattgtgacgatggtgctcagcacgatgatcagaaacagagcagccccgctggcggaaaacagtgacgggtaattgatgacgcccgtcatggccggaatgaataacagcggaagaaaagacagcaaaaatccggctccgtcttcaatcattttgacgggaatgatcttaaccgataaacatatgatcagcaggatcaaaccgatgatgcttccgggaatgggcaggtgaaagaactgctgaacggctcccccgataaaggaaaatgcgaataaaataatgatttgcaagatgatgcgtatgactttcacaacgatgctgttctttggagaagagcagcttccccctttcttgatgtttctataagtttctttacttttggcacatatatttgtactatacaaatatatgtatgcaaaatctttctatatgttttctgagtaaatgtgcatatgtttgtattatacaactaatgttgctgttgtcaatgtaaggagtgaggcgtttgtcaaaacaagatccgattgaattaattgaatatgaactcaccactttcatcaggagagctgtttatcttgataactccgaccgtaaaatcggacatctggaaagggctgcgtatttgttattacggcagctggatgaattcgggcctgcgcgtgtgaaggaattggccgaatcatttaagctggatatttctacattgtcacgccaggcagcggccttggagtcgaaagagctgatccagcgtttttctgatccttctgacgggcgggtcagtctgtttgcgattacgaagcttggcaaacagaggttaaaagctgataaaaagatgcgccttgagcggtatcatcgtatgcttgacgattggtccggcgatgaaaaagaaatgttcggccggcttttgctgcggctgaatgaggcatttatcgattaatgcatgatttttgccgggttaagcaggattatggcgtatacaagggtgaatggaacagagtaaggttttacgccattctgcttagcaaaaataatattgaatagggggcggaaaacgtttctcctgggaaataatgtttctcggaggctgcggcatttattatctcaatattcataattcaatgaaaatgaaagcgctttatttttactccggtggtccagagtgtaaggtgtttgcctgaaaaaaacaattgtattttccacgaaaatttattatgatggaataaggaaattggagattatataacgataggaagatagaatatttctaatattgcgggaaatgaagattgagttaggttcaacaggtgcaccttctgcttcattatttcacatatatcagagctgttaagaggaggaagcgaagtggcaaacaaagaattaaagagaggcttaggcgcgcgtcatatacagatgattgcgctgggcggcacgatcggtgtcggtttattcatggggtcatccagcacgatcggatggaccgggccgtctgtcctgctggcttatgcgatctcgggtatctttatcttttttatcatgcgtgcgatgggcgaaatgctctatgtagagccgagtacagggtcgtttgcgacattcggccataagtatatacatccgttagccggctatatgacggcgtggagcaactggtttcaatgggtgatcgtcgggatgtctgaaattatcgccgtcggttcgtatatgaaatattggtttcctgatctgccggcatggattcccggcattatcgccatggccattctcggtgcggcgaatttaatttcagtaaaatctttcggtgagtttgaattttggtttgccatgatcaaaatcgtcaccattattctgatgattgtggccggaatcggaattattttcttcggtttcggtaacggagggcatgcgatcggattatctaatttatggtcgcacggcggtttctttacaaatggtttttcaggatttttctttgctttgtctttggttgttgcggcctatcaaggggtcgagctgatcggaattacggcaggggaagcgaaggacccgcaaaaaacgctgcgaagcgcgattcagagcattatctggcgaattttgattttctacatcggtgcgattttcgtaatcgttaccgtatatccgtggaatgagcttcactcactcggcagtccgtttgtttcgacatttgcgaaagtcgggattacggcggcggccggtctgattaactttgtggtgattaccgctgcgatgtccggatgcaacagcgggatattcagtgcgggacgtatgctttatacgttaggcgtgaacggacaggcaccgaaattctttaagaaagtttcttcgagcggtgtgccgatattcggtacgcttgcggtattaatcggacttgtgatcggtgttgtgctgaactacatcgcgcctccgaaaatttttgtttatgtgtacagcgcgagtgtgctgccgggaatgattccgtggttcgtcattttgatcagccatctcggtttcagaagagcgaaaggcgctgagcttgataagcatccgtttaaaatgccttttgcgccgtttacaaactatttgacgatcgctttcttactcatggtattgatcggcatgtggtttaacaaagatacgcggatttctttggttgtcggggtgattttcctggcgattgtgacggtcagctattatgcgttcggtatcggcaagcgcatgcctggtgaaaaatcgaaaatagaagacgctgtataattcaaaaagacacctctcttacaggggtgtctttttcggcttgtccgcgagtggtatactggttaaaaaaagcagaaccgggggaaacatcgatgagtcattaccgtacgttattatttgatatagacaatacgctgctggattttaccgcttcagaaaccgatgctcttcaaaaattgttccaaggttcaaagctggagctgacggcagaggtggaagcccgttataaagcgttaaatcaagggctgtggaaggcgtttgaagagggggaaatgacccgcgatgaagtggtgaatacacggtttgcccttttgtttaaagaatacggccttgaagccgacggcgtgctgatgaatcaggcgtaccgccaatacttagaagaagggcaccagatgatagacggagcttatgagctgattgaacggctgagtcctttatttgatttatacatcgtgacgaacggcgtctcaagatcacaatataagcggctgggcgactccggtctgtatccgttttttaaagatgtgtttgtatctgaggacacgggttttcaaaagccgatgaaggaatactttgattatgtatttgcgagaattcccggtttttctgccgggcacgggcttattatcggcgattcattgagcgcggacataaaaggcggtcagatggcgggaatggatacgtgctggtttaatcccggaaagaaagcaaatgagtccgggattatcccgacgtatgaaattcattcgcttgatgagctgtatgatgtgctgaacgtggaggttgtagctttatgatttctcaatatatgtataatataatttatatcaagttgtctcgggaaggattattatgaaaaatctttcttcaattagtacaagagtgctcatagagaaaaccattatttgtttttccttatattctattatcagttctatttttaaaacgccaacttttacggcttcggaatccgcttacctgctgattatcaccatttttttagtcgtcaacgatcatatcagattaaaatacctaagcggtcagtattcttttagatattatgcatcttttttagtaagtaaccttttatcaggcattttattgtttaaaattaactgtctcggttctcaaatatataatattttcttactgatcgagattattgtaacaactcgtaaactgccctggactgtagtaagtctgcattttattattttttttacagctcttaaagcagcagggaccagcgggaaagatatattgatgtcctatttagtgatcatggctattatttatctgtttagaaacgtactgctcgaaaaagcaaaaatacaaacattaaataaagaattacaaagtgtaaacactaaacttaagaattattctcaaaaaattcaagagttaactatttctaaagagcggacaagaattgcacaagagcttcatgattccctggggcattatttgatcgcattaacaatgaatcttgaattcgccgataaaatagtaagtaaaaatcccggcgaggctaaacaagtcatcaataagtcacatgatttatcgaaggagtgtattattaacctgagagaagctgtcgctttgctcaatgaccctgctcctcaaaaagggcttctgaaatcgatcaatgagatttttgaaaattttcagcaaacaaatgaaataaaattcgagcttgatatggacaataaagtagagtcagctgatccagatatcaagaattgtctctataaaacagtacaagagtctataaccaacgggataaaacatggaaatgctacgtttttttcaataaaaatacgtaagtcttttgaaaaaatctctatatcgataactgataacggaacaggatgttctgaaattaataagtcaaatggaataaacggaatagaaaaaagatttgccgcacttggaggagaggttgatttttattcagggctagattctggatttactgtggaagccgtaatccccgagatagcagatctttaatccgaatgtgaggaggtattgatatggatattatcattgtggatgatcagcaaattgtcagggaagggcttaaaatgattctgagtctgcacgaggaaattaatattgtaggcgaagcttctaatggtgaacatttattagatttgctaaaacagataaggcctgaaatcattttaatggatataagaatgcccgtaatggacggcattgaagcaacaaagctagttaaagagagatattcggatattaaagtaattatcctgacaacctttaacgatagtgaatacatttttactggactgaaaagcggtgctgatggttacatactgaaagattctgattcacaagaaattattgattccatcaaaacagcatgtgaaggcaatattctgttaaatcctaaggtaacgctaaaagttgtaaaggctctaaattcggtagaacataataaagagcttgttcaagaaaataatgaaaaggaacagctggtgcaattgcttactcccagagaaaaagaagtcgctaaacagattatggaagggaaaagcaacaaagctataagcgaagcactgtttattactgaaggcacagtcaaaaattatgtatcaagaatactggaaaaacttcaaatgaacaaccgaacggagcttagcttatatttacaaaagcatatgtgattcaacttttttccttcaatcagaaaggaatttcatcaaattcctttcctccattttcttctgaatatatccggacttacaccttccgtgcatgactaaagtaacaatgcgattcgtaactaaagtaataaggtaaatgagtactatagtaaattctaaaaatattcaatccaggttaaaataaaagaaccgaaataccacgaggggtgttttaattatgcttgagttaaaaaaacttaccaaaaaatatgatgactttacggcagttaataatatttcgctgactgtagaagatggagaagtattcggactattgggtcctaacggtgccggcaaatcaacaatggtttctatgattagcactgttcttgcacctaccagcgggacaattaaagtagataataaatcacttaaggaaaaacctattgagataaaaaaaataatgggggttgttccgcaggatttagctttatatgaaacgttaagcgccaaagataacttgaacttcttcggaagcctttacgggctgaaagggaaaaagctaaaagaaagaactgatgaggttctggagattattgaactgacagataaaaaaaatcaaaatgtatcagagttttccgggggaatgaaacgccgggtcaacataggcgtggcgttaatgaataatcctaaattattaattcttgacgagcctacagtaggaattgatccgcaatcaagaaatcatatccttgaaacagtaaaaaggctgaataaagaaaaaggaatgactgttatttataccagccactacatggaagaagtagagtatctttgcgagaaggtggcaattgttgatcatggatctcttattgctttaggaacgaaagaagaactcaaggaaaacttaaatgcttgtgacactttaactgttacttttaagggtgctaatgaagaggcactcagccggataaacagcattacaggaattgataaagtgacggtagatcataaacaaatttcaatgcttgtatcgacgaaggaaagaaacatcattgaaattgtagatgatatcaaaaatctggggatcgacctcactagctttaagtacgaggaagtaaatttggaaagcattttccttcaaattacagggaaaaacctaagagattagtaggaggaggctatcttgagaaaattattcaacttattttttcttgattttaagctgttaacaaaaaataagtcattttatttaaagctgatgctgtttccatcactgctaatcctcatattgggcagtgtgttcagtaattcagattcaaaaatcgaagcatttgatgtagctttttactcagcagattcaggggagagtgtttctttaggtgatgtcttaaaggataaagtttttaagaaaggcgatctcaaagatatcattcatttaaaagaagctgagagctacaatgacggtgaaaaattagttaaagaaggaaaggctgcagcttttatctatgtaccgaaacactttacgaaagccgttatgaacaacgggaaaacaaatatcgatttaattggagataataataagaccatagataaaaatattgttcaggctgttttggagggctttacgaaaagcgtgaaaacaatgagtgctgagcaacaagaagtaataaaacatatcagccccggcggcagcgtaccaaaagaaaaaatagaaaaaatgatgaacgatttggccgataatgacgggatctccgctgatatcccaaaagcagcgacaaataaaaatgcggttcctgtcgattccatgcagtattattcaattgcgatggttgtcatgttttccattatgacggcttttgtgcttgttcatagcattgttgatgagcggcagaataatacgctgttcagaattaaatctacaccgactttaaatattcagtatgtgcttggaaagttgacaggtattatttttgcgatcttaatgcagatgactgctgttattctgataagctgggtcgtattccgaatgaactggggcaacttgtttgatatttttgttattacggtagtatacgcatttgctataggcagcattgtattgttttggggttttaccgctaaggaccacgtggcggtgtccagtatggcttctccggttctttatatttttagttttttgggaggcagttttatttctaagaacggactgcctgatagcttgagggttgtccaagagatcataccgaacggtaaggcaataaactcttatttaaaagtcaaacagaatattggtcttagtggcatgtatattgatttgcttgagctaattggtattggtctcatctttgtctttattaatattatggtattcaacaggaagaaggtggcgtagtagtgcaattgattgccatgattaaacatcagctgaagctgatgctccgaaatagattagcaatttttgcaactatttcagtgccgttaatccttacatttttgttctctttttctcaagatacggatagcaaagagaacttgtatatagccaatgctgataaaagcaactatgctgcaaagctcattgaaatgataaaagagcataaaaatattaaagttataaagctaacggaaaatgaaataaagaaaaaagtcgatgatcaggatattccttttggggtcgttattgaaaaaggttttggaaaggatttggcggacaatcacaagataaaaatgaaaatcatccaaaactatgagaacggcagcggaacattgttagagcagctggtcacaaatgaggcgggaactcttaaaaaggtagttaaagattcgcaatatatgtctgcacagttgcatacggactcaaaagatatagaaaaaaacattttcaagaaattgaaaaacaattcaggaatagaagtgaatgacaaaacattaagtcagggtgaacatactcaggataatgcgaccgtgagattaattggttttcttgtaatgtttatttggtttgttgttattcaagggttaagaacacttattgatgaaaaagagaataatactttcagcagattactaagtacgcctataaactatacaaaatatgttttatccaaaatggctgctacttatatttccggaatcattcatataatcgttataatacttgcgggaaaatatttactcaagatcagcataggtcataacatctttgccatcgctgttatgctcgctgtttatttatttgcattgacctgcattacgatgattatggttccatttatgagaagccaaaagcagtttacttctgccgcatcgatcataattgcagtaagcgggatgataggcggttcctttttctcattggaaattgctccaaaatatatgcaggttatttctaaatttacacccgaagcatgggcaatacagtctttaaacaacattatctttagtaagagtaccttaggaactgaatggcttccgatcgtaatttttgcaagtgtcggcttattaagtattattgtatctttcatcttaataagcagggagattaaaaaagaaaattaaatcaacaataatcggataaaattaacagatcaaaaaggacgtgagggaattgggtatggaagaactatttggaatggctgaattaattataggtgtactcatgaatgtatttatcggtaaaatcgggcaagttgcttttggaaaagataacagaacaacaaggatcattttaagagtaataggaatcttcctcatcatcaacggagtttcaagagcatttcatatataaaatgagatagtaaaaacatccttttcagggtgtttttttatcgggttattacaaaatttctgaggtgaattatgaaaaaaatattttgtcttccgtatgcagggggatcaagtgcaatatactataaatggagaaggttaatgagtggctctttaacaatacatcctattgagttaaaaggaagaggtacaagaattaacgaagatttttatgaacatatagatgaggctgttaatgatatatatgatctgataaaggatcaaatcagggagtgtgattatgctttattcggccacagtatgggaggccgattagtttataagttatattgtaaaattgctgaaatgcagcagaagaagcccaatcacatatttttttccggctgcggcattcctaaaacgaaaaaagcagaggggatgattcatgctttgccggataatttatttttgcaaagaatcatggatatgggcgggacttcggaagaactgttacataacaaggaattacaacaattatatcttcctattttaagaagtgatttcaaaatgttagaagaggatgttatttctgaaaataagactgttatggactgtgatataacagtgttgcatggtattaatgacaagacgataagctcagatttaatatgtaattggggacattatactttagggaaatgcaatttttatacgtttgaaggaaatcacttttttattcatcaattttcgaatgaaataactgacattataaataaaaccttgagataaattgttgattgaaaaatcgggagtgttactttgtcccggttttttttatgttaatacgaaaaataaaaactgggttaatgtgcttaggtgtttttccccgctaattgacaactcttaaacatttgtataatatttcttaaagatggctagttcttcttcattatccttttttttaaaaaagtgtttgtacgggtctatatcattaaaaaatggtttttgctgccgataaataaactgtcagactacaacaataattattggtgagcgttattgcctgtgatgcagtttaacataaaaatccaccgaaagcctctgctgttttaattcagtgaatgaattgaattttgatatcaagtgaaggagtttttgttatgacaaaaagtataaagggagataaaaacagtattggtgagttaaaaactgaagagcattttttagtgggaagtaaaccttctaaagaaaaaagaatgaaaaatcttacatataaattgtcacagcaattaagcgataagctgaatgtatgctgcaatggatcggatgaacgtctgcatgtcgtattaacagcggcactgactttgttaataaatcaatatacagaaagacaaaatattgtaatcaagactcctgttttcagaaagaacagaacgattgattctgagcaagaaattttgactcttaaaaatgctgttcatggtgaagacctattaaaagagatcatacataaagtcgaattcaccgtagaacaggcattggaaagcccccaaaataattctcgaacaagtgataaaatgactggccttccttttgatgtcatgatagtccttgaaaatattcaagaatacatacttaatcaagaaaatcccgctattcatatcctattttcgtttatgaaccagaaacaatacatagagacagccatacactataacgaatgcctctattctcaaaatatgataaaagatttgtcactgcgatttcagatgatccttgaagctatgataactcctgaaaatatcagagtgaaagatatgagattcctgaaagaaaaaaataagcaaaagaaaatctttggctgggaagataattattcgaaaattggaacaatttcagaggtgtttgagcagcaggctgatgaatattcggataagactgctttggtactagaaaactcttcaatgtgttacgcagaacttaatcaccgtgcgaaccagctggcacggtatcttcaggagtgcggagtaaaacggggagaccttgtcggaattgctttagaacgctcttttgatttgtatattagtattctggcaatattaaagtcaggcggtgcttatgtgccgttagaccctcaatatccgaagcaaagactatcattcttaatcgaagattcaggtgtagagttgctgattacaaacgaaagcattcagtcacaactcccgcctcacggggacggcgtaatctgtttggatggtatgaaagaagaaattgaaaagatggatggatctaatattggcataaaaggttccttggatgacctggcttatgtcatgtatacgtcaggctcaacgggactgcctaaaggagtaagtattgttaaccgcggtgtgattcggctggtgaaggagactgattatgcggtatttgatgagaatcaaacgtttctgcaattagcttctgccgcttttgacgcttctaccttcgagatctggggctgtttattgaatgggggatgtctggctataatgcctccgggaataccgacggctgatgatattgcagaagctgtaaaaaaatataacattacgactctttggctgacggccggtttattttctctagtagttgatcagcagttagaatcattaaaagggcttcagcaattattggtaggcggagatgtggtttccgttccgcatgttcaaaaagtattagcacttggaaaggtacaagtaattaacggatatggaccgacagagggaacgacctttacctgttgtttcccggtccctcatgattggaaaggcagtacgcttcctatagggaggcctatttctggtacagaaatattcattttagattcgcaattaaaaccggtagcgcctggtattcctggtgagctgtttattggcggagatgggctggcgcgagagtattggcgacggcctgatttaacgaaggaacggtttatatcacaccctttcaataatgatccttcagcacgtctttataaaacaggagacttagtgcgttatttagaaaatggcgatgtggagtttattggacggcgggacgagcaagtcaaaatccgcggttttagaatcgagcttggggagatagaagcccgattgatcaatcatacagaaattaaagaagcggctgtaacagtaaatcataatggtgatgatgatttatatatctgtgcttattacacttcaaatcataaaatcgcaaagattgaattgcagcactttctgagagactttcttccggaatatatggttccatcgtactttaaacaaatggataacatgcctttgacggtaaatgggaaaattgacagacgggcacttcctcgacctgatatatctcaaatgtccgaaacaaaatatgaagcgccgacaaatgaaacggagaaaaaactttcggagatttgggaagctgtacttggcagggaacgcgtcggtatagatgaaaatttctttgaaatcggtggtcattcattaaaggcctctatgttaatttcccgcatcagaaaaacattcggcacggatataaaggtgaaggagctttttgagcagcctaccatcaaacagttgagccgtcttattcaaaagcgggataaacagaattatccgatcatcagtaaagcgagaaagcagtcttcttatcaagcgtcatctgctcagaaaagaatgtttgccctttgggagacggataaagacagtatcgtttataacttgccgattatgatcgaactaaacggaaaattagatgtaaaaaaagccgaatcagttttacaagagattattggcagacacgaagcgttacggacaagtttcgatgttgtaaacggcgatgtggttcagattattcacgatacatggaagctcgaatttgattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcgggtcataaactaaaacagccgccgctgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatgtcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttacttttgagagtaaggattacggattcggaggaaatgaagagacagcagaatcaaatttactagtatctgaggtcaatatatcaagatttgatttaacgttaactgcaatggaaaccgatgaaggcgttaacttccaattggaatattgcaatcatttattcaggaaagacacagtcgaaagaatgggtgctcattatacccggcttttacaacaggttgtatcagaaccggacacggcaatctgcagactgaatatgataacggatgatgagaaacataaactgctttatgtattcaatgatacagtagccgacttcccgcataataagacaatccatcaattgtttgaagaacaagcggaaaagacaccggaaagaatagcggcagtgtatgaaaataataaagtaacttataaagaacttaacgaaagttcaaatagtctggcgagaacactaatgaaaatgggggtgaaaaaagagtcaatagtaggtattgttgctgacaaatcattagagatggtgttaggcatattgggtgtgctgaaggcgggaggcgcatttttgccaattgatccgggatatccttctgagagaatcaaatacatgattgaagacagcggttctgacattttattagtgcagaatagtcaggctgacaatattccgtttgacgggaaggttattgatttaacagatagttctctttacaccggagatcggcataacctgccaatgatgagttccgcagaacatcttgcttatgtcatttatacttctggaacgactggaaaaccaaagggtgtaacgatccggcatatcggaatcagtaatctcaaaagtgtctttgaacatgatatgaatatcaattaccgggataaaattattcaatttgcaagtttttcatttgatgcatcagtgtgggaaatcagtatggcactgttgaccggagcggaactacacatcctttcaagtcaagtcatcaataattatacattatttgaagagtatattaaccggcatgacattactgtagccactttgccgcctgtatacatcaaccatataaatataaacggattatcagctttaaggctcttaattactgctggttctcagatatctacaaaatccttgaaccggatcgtgaataaaatagactatattaatgcctacggtccaactgaaacgacaatctgctctacaatgtggagatactcagaagctgagagggcgatggcaaagaccgttcctatcggtaagccgatcagaaatctgaaagccttcataattgatcacaacaacaatcttgtgcctattggtttagcgggagaattgtgtgtgtcgggtgacagcttagcaagaggatatctcaataaagagaaaatgacgcgtgagaagtttattgatcatccatttgagtccggaactaaaatgtaccgaacaggagacttggcaaggtggcttcctgacggaaacatagaatttttggggagaattgataatcaagtcaaaatcagaggcttccggattgaaactgatgaaatagaaagccagcttctgaaaataagcgggataaaagaagcagttgttatagataagtgcgaccttcacggtgacaaatacctttctgcatttgtaaccgcagaatataaaatatccggagcagctttgagggagcaattgggcgacattttgccgcaatatatgattcccggtgtcatcatccaggttgaacagctgcctctcacaccaaatgggaaaattgacaggaaagcacttgcagaaatagaagagcctaaacatataaaggagcaccttgaagcaccccgttccgaagtcgaacagattctggtaaatgtttggtcggaagttctgaaaattgatgatattggtattaatgataattactatgagctgggcggagactcaataaaatctatactgattgtatcaaagcttcaagaatacagtctcagtctagatgtaaaagatcttttgcagtatccgcaaataaaaaacctcagtaaacacgtgaaattatataaagctcaaacagatcagagcccggttagcgggagaactgaactggcaccgatacaaaagtggtttatagagaatgactttgcggacattcaccactttaatcaggcattcatgtttcaagtgaaagaaaaaattaatgaacacgctctggcaaagacatttgaattattagtaaagcatcatgatgctttgaggttgatatatacagccgaaaatgacgaaataaaacaagaagtcagagatgtccaagccgcccgggatacttttactctggacatatatgatctgcttgctgatacggattacaaaaatacaatagaaaaacttgccgatcagttacaaagcggaatggatcttgaaaaagggcttttaatgaaacttggtttatttcgaacaatgaggggcgattatctacttattgctatacatcatatggtgattgacggagtctcttggagaattctgcttgaagatatggagcaggtctacaacaatctgcaaaaaggagagccggccgttcttccgccgaaaacggcatcctttcaagaatggacacgtaaattggcggaatatgcaaacggaagtgagataagaaaggaacttcggtattgggagaatatcgaaaaaacgaagattaaagaaattccgagagatttcaataaaactgacagtgtatttaaggaaagccgcaccattactgtcagtcttacaaagcagttaactgataagctccagaggaatacaaatgcagcttataacacacagattaatgacatcttgctttgttcactgggaatggcagtaaaagaatgggcgggaattgacaaggttttaatcggtctggaaggccacggaagagagaacatattagaaaacatttcaatagaaagaaccatcggctggttcacctcactatttccgatcgtgctggatatggagcacagtgatgatctgccttattgcataaaaaatacgaaagagtatttaagaagaatacctcataaaggtattggttacggaattattaaatacttgacggcaccggaacataaaaaagacatcagttttacgataaagcccgagatcgggtttaactatctgggagaaatctctcaaaaaaagcgggctgtttttcagcatgcagatatatcatctggtacaagtgtttctttatctaataaaaaattgaatgccatcgaaatcaacagctttattatggacggtcaactgcagttggaatttaactatagtacgaaagagtttaaagaagaaacaattaaaacattaaccgaatcctatataaaccggttaatcgatattattcagcattgcggaatgaaaaaaattcctgaaaaaacaccctttgactatggagatctggatttatccatcggagatttggagcaaattttatcaagcggaaaagagatagagaaaatccactccctgactcctatgcagagcgggatgctttatcatgcattgcttgatccgttttcacaagcctattttgagcagcttacattttctttatccggtcagcttgatattggcagattaaatacagcttttaatatgctgatcgagaagtatgaaattttaagaacatgcttttttcatgaaggactaagtaagtttaaacaggctgttctaagagagagaagagttaaaattgaatttgaagatatcagcactttctcggaatatcaaaagaaagtccggcttaaaaatgtccagtttaaagacaggggaacgagattcgatttgacgaatgattgcttaataagagtaaccgtattaaaaactgatgagaaagaatataaactgctgttcagttttcaccatattattatggatggctggtgtatgagtttaataatgaatgatataaaaactatttatacgtcattaaaagaaggcagagagacagtgcttcagcataccgagccttacagcacctacttagaatggctggataatcaggacaaaagtgccgcattagaatattggggggattatctaaatgaatatgagcagcaagccggtattccaaagttctgctgatgagggcgatttcaataataggaagaaaacattcattattgatgaaacatgtacttcgatgttgaaagctgcagctgatcaatatcacattactttaagtgcattgattcagactgcatggggagttcttttgcagaagtataacaacgtgaatgatgttgtgtttggtgcggttatttccggaagacaatgcagagtgcaaggcatagaaaaaatggtggggttatttatcaatgcggttcctctgagagtaaaaggcgatggtgatacggtatttatagcattagcccaaaagctgaacagtgactttatcaaagcgaatacatcatacggttacagttctttagcggatatacaagctcttacaaagatgaaagagaaactgatcaaccatatgttggtttatgaaaattaccctgttgatgactatggcaaggcggtcgataatacaactgatgctttaaggattacagatatggaagtgtttgaacagacgaactatgactttgggctggttattattccaggcagccaaatcaaagcagagatgacgtataacaataatgtttatcgtgaagatatcattaatcgtataggtgttaatttctgtcatgtattaaagcaagtggcaactaatcctacgcgagtcctaaaagacatcagcgctgtaaatgaagaagagcgcggaatgctccaggagtttaataagcagtcctctaattatacggtgaataaaacgatacaagacctttttgaagaacgagcggaaaagacacctgaccaaacagcggctgtctatgcaggaaagcatatcacttataaagagctaaacgaaaaggcaaatcaagttgcaacattattaatggaaaaaggggcaggaaaaaacagcattacggctatgatgatccgtccttcagaatattcaatgattgggatgctgggaattttaaaaaccggaagtgcgtttctgcctattgatgatgaatcaccggtcagtcggataaatcatattttaaaagatagcaaagctgatatcctcattacagatttgtgctttttagctgataaaaatattgcggcggaatgtttggatattacggataaatcgatttataccagccaaaatacatcaaaccctgatgttcagtatgatctcgaggacgaggtatatgttatatatacctcgggtacttcgggaaaaccgaagggggtgaaggtgaaaaataaatcattagttaattattcattatgggtatgtgatcaaataaacataaattctgacagcaggtcgttagtgacgtcaaaatatagttttgacttatgctataccagtatatttccagttttatccggtggcggacaagtccactttgttgataaagaagtgtatcttcactctctatcattaatagaatatattcataaaaatagtattacatatcttaaaatgacacccactttattttcaacattgatggaggatgttgacatgctggcgtcttgtcctgatttaaaagttattatactgggcggcgaaagcataaacatcggcaacgtcaaaaagctcgctgaaaaatgcagatggatggagtttattaaccattacgggccgaccgaaagcactgttggctgtattgcacatagcattgatctagatcatattcaaaactgtgaaatatacaatagaataggaagaccaattcacggtattaatatctatattgtggatcgttcagatcaactggtccctgtgggagcacccggtgagatttgtatcagcggggtaggtttagcatcgggatatgtcaataatgaagaattaacgaatgaaaaatttattgataatccttttcatcgtggagcaaaaatgtacaaaacaggagaccttggcagatggatgccggatggaaatatagaatttttaggccggattgacaaccaggtcaaaattaggggttttagagttgaaatcggagagatcgaaaaccaactattacagctggaaggtataaaagaagcggcggttgtttatatagaggagaaatatctttctgcatatattactggggacattgagatgggaggctcgttcgtacaggagaaattggcacaggctcttccgaagtatatgattccgagtttcataatacaactgaaagagttgcctcttacagctaacggaaaaatcaatcgaaaagagctgcctcttcctgacttgcaacggttgtcagtacctcaatacgaagctccggcaaatgaaacggaagaaaaactagctgaaatttggaaagaaatgcttgggcataaacggatcagtataaatgaagatttcttcgaactgggcggacattctttaacagctgcgttcactatttcccgcatcagaaaaacattcggcacggatataaaggtgaaggagctttttgagcagcctaccatcaaacagttgagccgtcttattcaaaagcgggataaacagaattatccgatcatcagtaaagcgagaaagcagtcttcttatcaagcatcatctgctcagaaaagaatgtttgccctttgggagacggataaagacagtatcgtttataacttgccgattatgatcgaactaaacggaaaattagatgtaaaaaaagccgaatcagttttacaagagattattggcagacacgaagcgttacggacaagtttcgatgttgtaaacggcgatgtggttcagattattcacgatacatggaagctcgaatttgattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcgggtcataaactaaaacagccgccgttgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatgtcatgctttcaaaatacagcggtcagcaggatgtgatcatcggaacagcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttgtacttgaaaatgcagattacggtattgaaaatcacctggatccaaatccggaagagcatattcaaaccgagatcaatatttcaaaattcgatttaacgttaaccgcgacggaaattgataaaggaatcaagttccacttggaatactccagtcaattatttgaaaaagaaacagccgagagaatgggtgcccattttacgaagcttttacaaagtgcagctgccggcctagatcaacctttaatgaaactggatttgattcctgaacaggagaagcacacattgctccatatattcaatgacacggcagctgaatttccgcggaataaaacgattcatcaattatttgaagagcaggcagaaaaaacacctgaacgtattgcggctgtccaagaagatacgctattaacctataaagaactaaacgagaaatcaaacagcctggctaatcttttgagacaaaaaggaattagagaaaacagcattgtcggaatcatgacagagagatctcttgagatgatcatcggaatgatcggggtgctgaaagcagggggagcgtatttgccgatagatcctgaatatcctgatgaaagagtaaattacatgctgaaagacagtgatgcaaacattctcctaattcaaaacggattgtcaggtggtattacattcaataaagaaattttatcattaagtgatcctgctctatatatgcataacagaagtaatctgccgaatgtcagttgcccggaagaccttgcctacatgatttatacttcagggactacagggctgccgaagggcgtcatggtaaaacataaaggcgtggtaaattatattcattgggcaaataagatatatgtaaatgatgaagatattgattttcctctgtattcttctatttcttttgacttaacggttacttcaatttatacaccgcttatttcaggaaataaaattattatttatgagggaccggacaaggctcttctgatcagaagaattatagaagaaaataaagcggatattattaagctaacgccgacgcatttgagattgctggagaatgtagatttaagtacgtcaaagataaaaaaaataatcgtcggcggggaagagctgaaaaccgggcttgcaaaaaagatacacggtgcatttaacggtcatgtcaaaatctacaatgaatacggcccgacagaggctacagtcgggtgtatgattcatcaatatcatattgaaagagacaatggcaatgcagtatcaataggcaaacctgcggataatactaagctttatatattaggaaaacaattggaattacttcctttaggggcagccggggaactttgtgtcagcggagaagggcttgcagacggatataaaaataaagcgggcttaacgtcagaaaaatttgtagataacccctttgaacccggggctaagttatacagaacaggggatatggcaaaatggatgccggacgggacaattgattatttaggaagaattgatgatcaagtcaaaatcagaggatatcgtattgaaacgggagaaatagaaaaccggcttctgaaaatgagtcacataagagaggctgttgttgtagcgagagatgaccaacatggggataaatatctctgcggttatgttacttccgacaaaaaaatagatgtttatgctttaaaagaaaatctgtctaaagaattaccgttatatatggtgccaagttatatcttccagattgaaaaaatgccgttaagttcaaacggaaaaatagatacgaaatcattgccgattatagatattgcggatgtattggagtctgcatatgaagcaccgcgaaataaaaaggaacaaattctcgcatgcgtatgggagaaagttctggggatgaaatcaatcgggattaactataactattacgagatcggcggagactcaattaaatccattttagtagtttccgaactccaaaaatacggcttaaaacttgaagtcagagatttaatgaaatatccgcacataaaagacttgagtgctcacgtaaaatcagctgatatacaagcagatcagtcgattgtagaaggagacgttgatctgacaccgattcaaaaatggtttatagaacagagatttgaacaagaaaaccactataaccaagcctttatgctttacaaaaagtccggcatagaagaaaaagcaatcgaaacggcctttttggaactggtgaggcatcatgatgccctcaggatgcagtttaaaaaggaaaacggtgaaattaagcaatggaataggggcattaaacaggcaaaagaaacatttactttagacgtatttgatatgacacaaacagaagatccagccatggcaattgaatcactggctgaccgtatgcagaacgaattgagcttggaaaaggggattttaataaaactggcggtatttaaaaccaaaaacggagatcatcttctattaaccattcatcatatgatcattgacggagtatcttggagaatcctattggaagattttgaaacagcttatcttcaaacagttaatgggaacaaggtggagctggaaactaaaacagcatcgttcaaagaatgggcgcgtcaattgaaagaatatgcaaacagcaaggctcttcaaaaggaagctgggtactgggagaccatagaaacggctattattgaacctcttccaaaggatttcattgctgaaagctgctcttatgaagatagtaaagaaattaaaattgaattaacagaggatcaaacaaaaacacttttaagaaatacaaatgcagcatatcatacacaaattaatgatatattgctttgctcactgggacttgcagccaaagaatggaccggcaacgagaagatccttgtgaatcttgaagggcacggccgtgaaagtgttataaaaaccccggtccatcgcacaataggctggtttacaacaatatacccaattgttctcgatatgacagaaagtaatagtttatcaagctccattaagtatacaaaggaaatgcttagacatatcccccataacgggattggttacggaatactcagatatttgtcggactcggttcatcttcaattaaaacctgatatcagctttaactacttgggtgaatttggccaagaagatcgcagcaacctatttcaaaaatcacctttgtccgccggaacgagcatatctggaagaaataaaaaaacacatagtatagaaataaatggatatatcatggatggcaggctgatgtttacgttcaattacagtgcaaaccaatataaacgagagacgattgagcaatttacgaaagcctatcaattgaaaataaatcagatcatagaacattgtgtgaataagaaaatatctgagaaaactccatgggattatggggatcccgatcttcaaatagaggagttaaatcaaattcttgcaagcggtgctgaagtagaaaaaattcattctctttcaccgatgcaggaaggcatgctgtataacgctgtgattgaccatcaatctagcgcttatttcgaacaaagtgaaataacagttgaaggaaatctgaatacagaagttctcagtgacgcattaaacaggctgattgctaaatatgaaatattaagaacgtcatttttctataacggtttccgtgtatttaaacaagccattttaaaagaaagaaaactaaacattcaatatcatgatatcagccaatgggaggagcagaagaaggatgcctttgtagggcaattcaaggtgagagacaggaatactccgtttgatctgaacaaagattgtctgatcagagtatcggtgatcaagctgggaagaaataaatttaaagtcatatacagtttccaccacattattttggatggctggagtgtcggtattctgttaaaagagcttatggatctatacggtgacgtggctgaagggaaaaaactccttcaagaatcacctgtaccgtacagtcattatcttgaatggcttgatcagcaggacaaggaccgtgcatttgaatattggaaggaatatctttctgcatatgaacaagagatctcatttccggaactggaattgaaatctgacgagtatcagcatgatcaaaaactgggagcacttaacggtgaaaccgccgctaagctgaaaaaaatcgctgagtcaaacagcattacattaaattctatcgttcaaacagcatgggggatattgcttcagaaatataacaatacaaatgatgtggtatttggttccattgtttcaggcagaccgagtgagataaacggaattgaaaatatggtcggcttatttataaatgcagtgccaatcagagtgaaaagagaatgtgatacatcatttatttcattggctaaacaaataaataaagactttattgaagcgaacgaatacagttattgttctctggcagacatacagtctttgacaagtatgaagaataaattaatcaatcacgtagtcgtgtatgaaaattacccgttgagtgaggatcttttcaaagattcagcccgttcaagtgtaaaaataactgctgaacaggggtttgaacaaaccaactatgatttagagcttttaattgctcccggtgacgacttgcatatgaaaatcacatataacgccagtgtttacagtaaagaaacggtaagttcaatcttagataacctggttagcatcttacagcaggcagcggctgatcatgaagtaatagtttctcagatcgatatggtaaatgagacagagaaacaaaagctggtgaaagaattcaactgcacggaattatcatataagaaagaaaagacgttacaagagctcttcgaagagcaagctgtaaggacacctgatgcaatcgctctggaatggaacggagacttcctgacctataaggagctgaataataaggcaaatcaattggcaagagccctcagggaaaacggcatcaaagagaatgttgtggttcctattttggtaagaaggtctttccgattgattataggaatattaggaatactaaaggcagggggatgctacttaccgcttgatcctgattatccggcagacaggatcaattatatgctgaaagacagtaaaagcggcctgctgttaactgaggaaggacttccaaatgaattaacgtacagcggaaccatatttaacatagattcagaggatttattacatcagttggaggcgaacattgatgttattaacagggccgaagatttagcatatgtcatttatacgtcgggatcaaccggaaaaccgaaaggggtcgccgtagagcaccgtgccgttcataactttattaagggaataacagacaggatcagcttttcacaagacaatgtccttctttcggtcaccacgtgctcatttgacatattcggattagagtcgctgctgcctttaactcaagggctgaaagttgtcatagccggtgaagcggaacaaagagatccgtacttgttaaacaagatcgttgttgagactgatgtcaatactattcagcttacgccatccagattaaagctgatgctaagtgcagaaaacagcacggagagtcttcagaaattgaagaccatcatggttgggggcgaggtatttcaacgggaattgttatttgagctaaaaaaatataaaaatctgaagatctataatatgtacggtccgactgagacgacgatttggtcttctgtgaaagacttaaccaatgaaaatagtgtaaatataggcaagccgattgcgaatacacagatatatatagtagatcatgatggaaacactgtaccgctcggcagtactggcgaattatgcattgctggagccggaatggccagaggatatttaggaaaagaagatttgactgcgcaaaagtttgtagacaatccgtttgttaaaggaaccaagatgtataagacaggagatttagcaaggtggctgccaaatggtgaactggacgttatcggaagaatggacaatcaggtaaagatcagagggtatcggatagaattgggagagattgaaagcatagtaaaccaacacgaaaaagttaaggaatgtgtagctgccggaaaaacaaattccgcaggagtccaagatttagttctgtattatgtggcagaaagcactgtatatccttcagaatttattaagttattatcacctgtgcttcctgagtatatgattccgcagatctttatgaaaattgaccaaattccgctgacagcaaacggaaaaataaatgtcctggcactgcctgaacctgttatagatagaacaggttttgaccggccttttgaggaagcggtaacggatgtacaaaaaagtatcagccgtgtttggaccgatgttttaaaaatagaagagcctggaatacatgataacttctttgaagcaggcggtaattcaatcaaaatcgttgcagtttataatgagcttcagaagctgtatccaaaacaaattcaaattgctgacttgtttgcatatccgactatttacagattgtccgaatatatagaatcagctatagcctttgcggagatagcagtgtccttggaaaaagaaatcattcctattactttaccgcttgaatacatctcggaatcaactggacaaagtcatacagccatgcacgaatatgcggtaaatgcgaattattatgatggtttaaaaacaatatgcaatacctacaaatatgatatttctcatgttttattagcgggttatgtatttttattagctgatgtcagccagcaaaacttgattcatatccaattttcgggtcatggagatgatcggatgagccagctgtcttttgatctgtctgatatcgagaattttcacgatattattcgtatggcgaaggagcagattgagaatcaagaggattcagatcaatacgatttgaatactcactataagaaatcaagttcggcccaagatgtttttcctcttttttatattagtaatgaatcaaaaaaagagtactcagaattatatgatctggtttttgcagttcatgaaaagccatccgaagcagaaatcgtttttatatataaccatcagaaactaaatgagcacaaaatgaaagatttattttataactacatgaatttaattcaagtgattacagcagacaaagcagacaattcaatataaagcggccggttctgccttacattttgctgatcggcagaatgtaaggcaaatcaggcattatagagactttggaggtatttaaatgtcgaaaataggttttttattttcaggacaaggatctcaatatgcaggaatgggcaaacgtttatgtgacaattttattatcgctaaaaaaacgtatgacgaagccagtgatgcattgggatttgacctgaagaaattatgtatagatggaagtgccgctgagctatctcaaacagaaaatactcagccggccatcctggcaacaagtattgcacaattcagaatctacatggaagaggtcggaaaagaacctgaatatatcgccggccatagtttaggagaatattctgccttggtttgcagtgacgttttggatttccaggacgctgtaaagctggtgagagccagaggattattaatgaaagaagctgccgaacaagggaccggagcaatggctgttatcaggaacctggatgaaagaatagcagaagaagagtgcgaatctctctcttcaagaggaaaaacgattgctgtttctaactacaatggatataaagatgttgtggtatccggagaagcggttgcagttgaagagcttagtgaaactcttaaagccagaggagcagacatttttaaattaaatgtaagtgctgcttttcattctccgatcatgggttttgctgcggaaaaattcagccatgagttaaaaaagtatgatctcagaactccaaaatacaaagttttatctaatgtgacggctcttccatattcagataaacagcaaatggctgacatactgggaactcaaatcgtaaaaccggtaaattggatgggaatcatgaagtatttagaagcaaatcatactgatactgtgattgaatttgggccgaaatctgtattaaggaatcttgtaagaaacaatatcgctgacatcaaatcgtacagctacgacaaagaagaggacgtgaagattataaaagagactcttttgaacgaatctgtttcactgcaagccggtttttctattatctcgagaagtttagggatcgcggttgctactaaaaattacaactggaacaatgaggaatacgccaaaggtgtaatcgaaccatatgaaaaagtagctgccatacaggctgaacttgaaacatcaggtcgtcagccgtcaagagaacaaatgcatatggcagtagaaatgctgaagtcagtgtttcgaacaaaaaaaacccctatagatgaacagaaaaaaagatttaatcaattattttctgaaacaaacacaaaaaaacactttgaagactttgaagtttgacaggtatgatcacctatctagtgattctcagcgaggtaaaaaaatgaaaacagactttataagtttaagtaacttaaaagcggccgcttttacaaatcaaactcctaatgtaaagaaacaaaaaaacgaggaagggaccaaagacatttccggagatgacgttgccattgtcggtttatcatgcagaatcggcgaagccaatcacgtaaatgaatattgggatttacttttacaaggaaaagagttcatcagagacattcctctgaacagaaaaaaagatgctgaccagtcattaaaaaacagcggaaccaagtacagtaaagatgcagcctatacaaaaatagcctatatggatgagattgataaatttgattgtgactttttcagtatcattccaaatgaagcaaagttgattgatcccagacaaagattatttattgaaacggcctggaacgcattggaagacgggggttacggcggcggaaaattatgtgggacaaatacgggagtatacattggactcagcagtgacggctcaaatgaatacttcagattgcttgaaaaaggagatcaatcgttactcggactggctaccgcgggtaacattaaatcagttatcgcaagcagactgtcatatatcttggattttaaagggccagcaatggtaatcgatactgcatgctcttcatcgcttgtcgccctccatacggcttgtcaggcaataagaaataaggattgcgatatggcattagccggcggagtgaatataaaagtattcccaaagacaatagaggagagcaggttaaatatcgggaattcttcatctgattttgctgtaaggactttcgatgattctgctgacggcacgaatagcggcgaaggtgtcgctgccgtattgctgaagccgctggcccaagcgattcgtgatcatgaccagatctatgcagtcattaaggggagcgctgttaaccaggacggcagctcagtaggaattaccgctcctaacgcagcagctcaagaacaagtaatagtagatgcgtggaaaaatgcaaaaatagatcctaaaacaattacatatattgaagctcatgggacagggaccaaattaggggatccgattgaaataaatgcgttgcaacgggctttcagaaaatatacagaccgaaaacagttctgtgccgtatcttcagtcaaaacaaacatcgggcatcttgatagtttggcgggaatagcgggtttaattaaagcggtaatggcattaaagcataaaaaaattccgccaagtttacattttaaagtgccgaaccgaaatatcaattttcatgaatcgcctgtttacgtcaatgactccgtttcagcatgggagagcagcggagtatacaggtgcggcatcagcagttttgggctgagcggtacaaactgtcatgtcattttagaagaggcacccgcagttgaaaaagttgatcaatccgttttatctgaacatatttttactgtatcagctaggactaaaacatctctcgcgcacttgcttacagatcatattgattatttaaagagagaaacagatgtgaatctgggagatatatgttatacagcaaacactgggagattgccaaacaaatacagactcgctatggtaataagctctgtcgcggaactgctggaaaagctggagtttttatcatgctctgaatggaaaacgtatcgggagaaaaatatatactttcaatcgataacaaatcaaacaaagtttataggaaaaacgcatacagacagtgtgcagaatactcaaacaataaaaaatgtgattcaacgagtcagacaagacgtctctaatatttcaacctctgacttacatattttatgtgaaatgtattgtgatggggcgaatattaactttgaagatctttatagcgagatgaattttcaaaaggtcagcttgccgacatacaaattcagcggaaaaagattatgggctgagctggctgcagacggcccttcagccgatgagaaaaaacaatctttattgagcaatcttgcagtgcagtcactgaatctggaagtgtatatatcccatttgaatgtcactgattattggtttttaaatgaacataaagtgaatgattcttacgttatccctggaacggtttatatagaaacagctagagaagcgggaagaaaatacttcggcggacctgtaggcattctgttaaaagacgttacgttttcaaatcagttaaaggtaaaagcaaatgaagttaaagaagttcatacgatcataaagaaaaaggacagcgttttagagtttagtgtgataagtaagtccggcgataaatggataaaacacgcggaagcggtcattgcgaaagaagaaccggtacgggaaacatatgacattgaggatttaaagaaaagctttaattctgtttatgtcattcaacgtaataatcatccattgacagaaataaacaccgatgaatacaagtcggtttatcatatagaagataccaatagaccggaaagcatcgttcaagtcggaggcagatggaaatgcaccaacgcaatctacagagacgacgacaggcttctatgtgaattggaattgccgaaagaatatgagagtgatttcgttcagttttcgcttcatcctgcgatgatggattgtgccgttaatgccgggacattcacaatagataacgaaacctatctcccttatttttataaagaatttaagatttatggctctgcttctaaaaagttttacagttatatcaagaaaaagagccgaagcaacggggaaacaggaacgtttcgcatcgtcctgctgaatgacagtggagaagttttcggtgaaatcaacaattacatcgtaaaaagggtgcataaagcagctgaaaagactaaaagaaacaatatatatcataagctatcttggataagagaaagcgatcaatcaaacgagatgcgagaaattcatcatcctattttattatttaagaataatggctgcagtttatccgaggaaatcattcgaaggttagaactggaagggaaaactgtgattgtcgcggaacagggtgactatttctctaaaatcggaagccatcattatacagtcagtgattctcaagaagattatgactgtcttgtaaaagctcttcaaagtgaaaaggtttctcagattgtccatttgatgtctatcagcaatgagaaagacaaaaacatatatcagcttcagaaaaaaatatcctcaggggtagacagtttattttatttaacaaaatcacttgtaaaaaatacaaaaaataacatagaactgatgctgtttgcagaccttgcacatcaagtaagcggtgaagaaccagacattaacccgcataatgcggcatttttcggttttggaaaagtaattgaaaaggaatattcgcgtgtaagtgtcagatgcatagatttggatcaaaatcttatggcggaaagcatcttgtttgaaatcaactcaaaaaaacagtcagagcttgtcgcttacagagaccggcataaatacgttcaagagctccagactgaagacttatccgtaattcgggaagggaaaataagcatcagaaagaacggtgtatatgttattaccggcggtatgggcggactgggattagaaatggccaagtatttatcatcaaaagaaaatgtccaattaatcctcattggacgctccgagcagcagatcaacatggagaagggaaacaacaagaaaatcgatgctctaaaagaaataaaagaaagcggttctaaggtagattactataaggccgatgtcgcaaatgaaagtgaaatgattcatgtattcgaggaaataaagagtaaatacaatacaatccacggtgtcatacatagtgctggtgtttctggagatgggtttattttcagaaaggaaaaaaaagtgtttgataacgtgctcagaccgaaagttaatggaacatggatattaaacgagctgacaaagcatgagcatctggatttcttcataatgttttcttctatcacagcacttgcggggagtatggggcaggctgattatactgcggctaatgcctacctggattcctttgcagaacgcagacagcgaagaagaccggatgaaaaaacagttacgattaattggtgcggctggtctgatgtgggtatgcttgccgaatatattgaagagcgtcaaaaggccggaaacgaacataaagatgaaaacggctttaagacgattacctcagctgaagcgatacgtgccttcgatgaagtcatgcaaaaggacatccggaatgtgatcatcggggaaattgatcatcgggtactggaattaaatcaagatcaaattcatttccgattatctccggatatattgacttttaaggagcaggcgattgtaaaaaaatctgttgagtcgaaaaccgatcagacatttagcttcagcgatattgaaaataaactaatgaaagcttggataaaagttttaggcttagaacaaatcagtataactgataaattttatgatttgggcggagattcaatatccgcgatatatctggtaaaagaaatagagaaagaatggccttctctcattgatgtttctgatatttttacgtatccctccattaaggagatgtcaagctaccttgaatcccacttcagtgatcagaagtcttctgaccgaatccctgaagaagacaatgaagatgacctggatgcaattttgaataagctggcatccggagagatggaagtcagcgaagcaaatcaaatatttcatccagaccgaaaataactgaattgggcctgtaagaatatattcgcaaaatggaatattggcaggctgcgaattgaatgaagaaaaagcagcctgcctatcacattattatgggaattgaattccattttaaggtaaaaatgtagatcttattacccttcctatcaaaaattttcttagaaagaaagcgggagtgatccgtaatgaatagcgttcaatcttatatatttgaacaagtgaaacagcataagctaagccagaaagaagcaaagcgaatgctaaaagaattaaaggctgcaagcagcaatgaagatattgctatcattggaatttcctgcagactgccgaaagcaaacaatacagatgaatactggaagaatctgatgaatggagaagactgcaaagcggaatatccaaaagatatgatcaattacattaaaccgatcgtaaacaataaagggtttactgattttctcggttcaggatatctgacggaagaacaagcagataactggaaacctggcggatatttagaagacgtagacaagttcgatcctgaattttttaatatttctcctaaagaagcaaaggccattgacccgtctcacagagtattgctggagacggtatggactgcgattgaagatgcagggtatgcaggggacaaaatttatggaagcaacacatcgctctttgttggaaaagaccatgtcaataatacgttgtaccgctacattacagaatcagaatcgacaagtatgacgggcaactggccgggtttgatggcggggcggattaattatttattaaatttaaaaggaagttctatggttttggattctgcttgcagctcggggctgcttggtgtgcatcttgcctgtaatgctttgaaaaataaagaatgcgatatgtctattgtcagcggaatttcattaggattctttccgcgcttcaaaacgtccaaaaaatcaatgatggaatcagtaagtgataaagtacactcatttgataaagacgcagacgggacatttttcagtgacggagtagcggcagtcatcttaaaacctttaagtaaagccaagcaggacggagatcatatttatgctgttatcaaagggagtgcagttaataatgacggggcctcaaacggattgacagctccaaatgccatcgcccaggaagaagtactggttcaggcatgggaaaatgctcaaattgatcccgaaaccattcaatatatcgaagcgcacggtacaggcacaaagcttggagatccaattgaaataaaggggatttccaatgcgttttcaaaatatacggacaagctgcagttttgcgggatcggatctgttaaatctaatattggccataccgttgccgtttcgggtttggcgtcacttatcaagatcgttctgtctatgaagcatcaagtcatccctccgagtattaattttaaagaaccgaattcattgattaactttgtgaagtcacctgtatttgttacagacaaagcccatgaatggcctaaaaataactcaccgaggagagcgggtatcagttctttcggctttgtggggaccaattcacatgtagtgattgaagatgctggagatgaggttgaagaggtcattcctgcaaatgaaacatttgagatatttactttatcagctaaaacagagaattctttaatgaaactcatcaaggaatataatgaattctttaaaaaaggaactcaaaaaaacgtaaaacatatttgctatacagcaaacacaggacggggccattacggctaccgattggctctgattgtaaaaagttacgaagaattaaagagaaaaatcggcaggcttgcaggacataacttgaatgaaatatcagaaaaaggcgtatatttttctttccataaagttggttctgatagaaaacagattatggatgaaggagaaatttccttatctgaacatcgcaaaatgaatgctcaatctgacaatttgatacatgacattcttactgaaggggatgaatatttactgctaaaccttacggaaatttgcaacctgtatgtcagaggagcaaaagtagaatggacaaaaatgtacaaggatgagcgcagaaagattgtcagtcttccgacataccaatttgaaagaacattatgctggggagaagtaaaggacagaagagatgaagcgccgcatcagaaaaatatcagtcacccgctgattgaccagtgtttggctgattcaatgaatgagacgatctattcaacgacatttaatgtgaataaggattgggttttaagtgaccataaaattatgggggcttgcgttattccgggaacgacttatatcgaaatgggaagaagagcaagtgccgcttactataaaagcaatcaattagaattacgagatattatcttcttcactccattaacggtaaatgaggatgagaataagattgtacacacaatcattaagaaaaagaaagaatgtattcaatttataatagccagtcaggaaggagaaacctggattacacatgcagaaggaaaagcgtttccattaacagactctgtatcaatgtttgatttagactctgttaggaatgacagtaatagagagaagataaaagtcaattatgaaaataaaaatggtttaatcagcaaagtttttactttcggaccgaggtggctgaacttcaaagaagtcatactgggccctgatgaacaattggccgaattaaaattggctgatgaatttacagcagatttaaaagacgtctttttacatccagctttgctagataatgcagtgaacgtgtttattggagaagatgatgacgatagtacattccttcctttttcatataaaagcgtgaagatttactcaagaatgccgcagcatttttatgcatttgtcaaaaagaacgcaagcagtaaagagacaaagctgtgtgatattcagttaatagatacagaaggaaatgtttttgcagaaatcaccgattatgtattaaaaaaagtaaatcggattaatgccctttttgaagaaagttctgaatcactttatcaattaaaatggatggcgcaagaagcttttgaagaagaaaaaacagaggtaacaggtcctatactgttatttaaagacaacatggaaatttataaatctatactggaacagttgaaaattcatgacgatgatgttattgaagtggagtttggggatgaatttcagaagataaatgggcggaaattcctaattaccggatcagaagaagactatgttcaattattgcatagcataaacgatcaaaatatcagcagcattatacatatgtcttctatcagccgccaaggaacggaatcattaacagatttagaagacatgcagaataaaggcgtatacagtctgttccgcttagtccggggattaagtaagaataagatgaaaagcaatattaatttgcatcttatttctgatcttgtgacagaagtgtccggagaagaaaatacaatcaatccattgggcgccgcgttgtttggtctgggacgtgttatttcgcaggagttccaaaatgtttcatgtaaagcaattgatattgatgaacatacttcaccggaaattattagtgaggagttaagaacaaaagggaaacactatcaagtcgcctttagggatggtaagcggtatatcagtcggttggatatggttgaaccgataaaggataagaaacacggcggtatggagattaaagaaaacggtgtctatatgattaccggcggcaccggcggaatcggtttggagatcgcaaagcacctggctggaaaacataacgtcaatgctgtattgctcaatcgctctaaactgcctgatcaaagccgatgggacgatatcattgctgatggaacggatttaaagctttgcagaaaactgaagtccatcagagctatcgagtcaatgggttctaaagttgatagctacagctgtgaagtttctgacttaaacagcatggagccggtaattgaagaaataaaacagaaatacggtacgatcaatggcgtgttccattgtgccggagttgccggggacggtttcctctttagaaaagaagctaatatttttaaagaagtgctcgctcctaaaattaatggaacatgggttatcaatcatttaacgagagacgtagatttagatttcacgattttgttctcctcaattaattctattttcggaggtgccggacagggagattatacagctgcaaatgcttatttagattcctttgcttatatgcaaaacaaacaggggaaaaacacgctgtcaattaactggccggcttgggatgaggtcggcatagctgtcgattatggaattactgatgagagctctattttcagattattgacggtagaaagggctatttccgttttagaagaaatagcatcgaataagcttactaatatcattccaggtacattaaatatgaagctcctcgcttttgcaaaggatgaattgtcttttgaattatctgagcaaatcaaaaacaaattaatagataaaaacaggacaaaaaacgaagcagaaaaacgtcgaagaacagatactgaagatatagtgctgaaaggaaagggagaactttactccgataccgaaaaaagtattgcgcaaatgtactctatggttttggatatgcaagagctggatttatatgaaagctttagtgccatgggcggagattctattatggcaacccaactgttaaaactgataaatcaacaatatcctgacattgtggatatatccgatatatttacatattcctctgtagtggagctatcagagtatattgacaagcagctgaataaagatcaacagcaagaaacggaagaagatactgctgaaaatcggcttgagcaagaactcaacaatctatttgacgacctggagaacggcaaaatcaatatacaagaaggattgaaaattctagaaaactagtttcggaaaaggggaaaattaatgaagaatacagaagaaaacaagtctgcaatcataatcggaggcggtattgcaggaatggccgcgggctgttacttgcaaatgaacggatacagcacaaaaatttttgaaatgggcttgctgccgggtggtttatgtaccggctggaagagaaaagggtacttttttgacggttgtatcagctggctggtcggttcaggacctaacaatacattccataaattttggaaagaactgaacgtaatacaaaatatggaattcattaatgatgaagaatttgcggttgttaactttagaaatggtgatacatttacgctgtatgctgatgtagataaattagaacaggagtttttaagagttgcacctgaagatgcgaaaacaattaagcttttaactgatggcattcgagttgtttctgatgtagagctggatttggataaagcgcccgaactgttcgatttagcagactttgaggctttcaaagcaaaggctggcccttacatgaaagtaatggggcaatggggaaaagtgacgatcaaagaattcgcccagcgctttaaaagcagttttgtaagagaaaatgtaaatcgtctgttttggtttaatgtagatacccctatatcttactttatggctactttaggctgggctaatagcaaatcttcaggacatcctgtagaaggttctctgcaattcgcaaaaattattgaagccagatatgttgaattaggcggtgagattcaatataaatcacctgtttctaaggttttagtagaaaatgataaagcgatcggaatagagctgaaaaacggacagtgtcattatggagatagcgtcatttcagcagcggatggctataaaactatttttgaaatgctggatggaaaatatacagatgatgaactgacattttgttatgacaaccttaaaacaagtgcaccgcaaatttatgtcggattgggcgtatcaaaaacgtttgaaaaatatcctcattatttgagcctggaattagaacagcctcttaatgcctatggctgtgacaacgttaaaaacatatttgtgaaaatatataacgaaaatccttcattcgcgcctgatggcaaaacgagtattatcgtgtatgcgaaaacttctgctgaatactgggagactttgcaaaaaaacaaccgcgaaaaatatgaagaagagaaaaaagcaattgcgaatgtaatgattgatgaattagacaaatggtttggtgaaattaaatcaaatattgatgtgactgatgtatccaccccatatacgatcagaagatacacaaataatagaaatggaagctggcagggctgggaaaaacagatggaaggcatcatgcacgagaaaaaactgaaacgttcacttcccggacttaaagacttttatatggttgggcattggagtcaagtgggaggaggtcttccgagtgttgtcttacaggccagaaatctggtgcaggtgttatgtaaagaagatggaaaggtttttgagacaaaaattaactaattcaatatgctgcttcaattgaagcagctattctatatatccatgatgcttctcatattttatatagaatcaaaatcgataggggtgattaatcgtggatgatatttcgattataaaacaatatgtattggagcaagtaaaagagcaaaaaatggacagggaaatggctttgcgcattttaaaaggattatctgataagtccaagaaaaatcaatgtgatattgccattatcggcatatcctgccgtttctcaaaagccaataatgcaaaagaatactggcaaaacattatgaaccgtgcctcatgcatccgggacttaccggagaagcggcggaaagatattgatccattgctgcccagtgcgaatgagaattcttattttagagcgggattcttagatgaaattgataagtttgattcatcatttttcagaatttcgccaagagaagctatgcttatggatccgaaacaaagattgtttttggagacagtttatcacgctattgaggactccggttatgcggggaacaagttacaaggttcgaatacaggtattttcgttggacatgatcatagcggtgacttgaagttttcctatgcttccctagtaaatgatgcggatatgattgcaatgacaggtacttatcccggcatattagcaagcaggacctcctacatttttaatctgaaagggccaagcttggttgttgatacagcctgctcttccggactcgtttcggttcatcttgcttgtgaggcacttaaaaatgaagaatgcagcatggctattgcgggaggcgttaatttatttctgagacctgaaaatataggtacgatgagcgaaatagaagcggaaaacgctaaaatcagcatttttgataaaaatgcaaaggggaccgcatggggtgaggggatttctgctattgtattaaaacctttacatagggctatagaagacagagaccacatatatgctgtcattaaagggagcgctacgaataatgacggggcttctaacggaatcaccgctcctaatgctgaatcacaagagaaattgatttcgcgtgcctggaagaatgcgaatattagtccggaaactatttcttatattgaaacgcatggaacaggcacgattttgggagacccgattgagatcaaagggataacgaatgcgtttaagaaatataccgataaaaagcagttttgcggtataggttcagtcaaacccaatatcggccatacagtcggggcatcaggcatggcgtctctcattaaagcatgcatggctttaaaagagaaggtcatccccccaagtatcaactttaatgaaccgaatcctttaattaatttttcgaattcacctgtttatgtgaatgacatgataagaaattgggaaaaaggagagacgccaagaagagccggtgtaagttcgttcggcttcagcggaaccaactgtcatattgtattggaagaagcacctgaaataataggtgagactgaacagagacaggtaaaagaggtattcactctgtctgcaaaaaataagtccgtcctgaatgatatagcatcaaagtatcttcattttatctcggaagaaaacaatttgaatctctctgatctttgttatacagcgaatacgggaagaaaacatctggagaatagagtgtgttttctcgtaaaagacatcgaagatctgaaggaaaaacttgaaagtctgctcgaagcgccggttaagcaagaagaagctgcattttcttttaagaccgatagagatctaagtaccgctgctggaaaaaaacttaaggcttatggtgcaggcgggagaacagatgagagtcttctgattgatataagcaagctctatgaaaaaggtgcagagattgattgggaaatgttatatgaaggagaaaaaagaagaaaaatcagcttgccgggttacgcatttttgcgggagagacattgggtgaaactgcctgaaaaattaccgataagcaatgcaccagataacccttcagtcaacaagcctcaaataataagactgagtggcagggaagacggctgttattcagaaacagagctaatggcaggacaaatttggggaaatgcccttggaatcaatccgatcgatgttacatccgatttttatgaaatgggcggagattcaatcatagcaatagaaatcatcaactttatcaataaacagcaaggaacggagctttcagtttcagacttgctaaagcattcgaatataaaactcttctcagcttatttggatgaatattctctgaggaagacaaatgatgtgaatgtgattcccaaagcaggcgatttagagtggtatgaggcatcatctgcacagaaaagaatttttattctagatcaattaaataaaaacagcacttcttataatatcccgttctttttaatgattgaaggagagttggacgataaacgtttagaagatgcgtttaaaaaattaataatcaggcatgaggttttaagaacgtccataggtttaagggacgggcagcttgtgcaaatcatagaaaaagacgttcgatttaaaatggatagaatcaagacctccgaagaagaattagagagccttatggctaattttgtccgcccgtttgatgtagaaaaggctcctttactgcgtgcaggattagccgagattagtcatcaaaaacatcttttaatgatagatttacagcatattatagcggatggggcgtctatcccgatcctccaaagggaattgataaatttatacgaaggcaacgaactgccgtcattgaacattcaatttaaggattttgcgatatggcaaaatgaattatttcataatgaagaaatgaaaaaacaaaaagatttttggttaaatgagtttaaaggagaaattcccgttctcaatctgcccgcagatttttcaagagaagccgaacgagatgatcaaggtgaacgaatctatttttatgcaggaagagagctgaccgccaagttaacagaattaaacgcaaaacaaaaagtcacccttttcatgactttaatggcttcatttaatgtgcttctccataaacttactggtcaagaagatattattatcggcacacctgtagccggaagaaagcataaagaattagaaaacatgataggaatgtttgtaaatacgctggcactgagaaataaaccatctgccgacaaaacattcaaagaactgcttgaagccgttagggataatgcgcttctggcttatgaaaatcaagattatccttttgaagagcttgtagaccatttgaaccttaggagggatataaaccagaatgctcttttcaacgttatgtttgtccttcagctgatggataatccggcaattgaagtaaatgggctgaaatataagccgtatctttacgaaaacaaaacagctaaatttgatcttctgcttcaagcattcccttcaaaagaggatatcaagtttgagttcacttattcatcaaacttgtttaagcgcacaactgtagaaaaattctcacagcgattcttaatgatcctcaattatattgttgaaagtcaaaatggactaatcggggagattaacattttagaagaaaatgaacgacgcgaaatattgagttacagtggaagatcactgagaagcagaggcacagatgcatctatctgtgagctttttgagaagcaggcggaagcaacgccgaatcaaatagctgtgtctgcacaagacggaagcttaacttatagtgagctgaacaaaaatgcaaacaggcttggaagagcactcattcaaaaaggtgtcaaaaagaatgaagcagtaggcatagctgcagaccgaaccactgattttatcatcggaataatgggaattttaaaagcaggagcagcttatctgccaattgatccatcatatccgcaagaaagagttgagtatatgctcaaagacagcgggacccgtttgttactgacggatcgcaacaatcattgtcaaaggtacggagtagaaagtgtttgtctgaatgaattggaaacagttccagacgacgggaggaatgttaaaggaggaccggaacggcatagccttgcctatatcatctacacttctggatcaacgggacacccaaaaggtgtgatgatcgaacataaaagtatagcgaatttaacagaagccctgcatgaacgtatctactgcaaacatggcgggcagcagaatgtagcgttgttggcacccttttcctttgacgcttctgtcaaacagattttttctgcactgcttttgggacactctctttacatcgtctctgaagaagccaggcatgatatcacgaaacttgctgaattctatatccaaaataaaataactatttctgatggaacaccagcctatctcagcctgctctctgagtctccgcagtgtggccgtataggtgtaaaacattttattataggcggcgaagtgcttaaacctgaagaagtaaagcgtttctataaagtatttaaaaagaatgaccgtccttatataacaaatgtatatggaccgacggaatgctgtgttgatgctgcagcttatacgataaaccaggataatatttccaatataaagagaatccctatcggcacaccgataaaaaactgttctatctacatactagataaacagcagaagcctgtgccgccgggagttatcggagagttatacatcggaggggaaggagttggacggggctattgcaatcgtgaagaactaaccaaggctaaatttatcccggatcttgttcattctggtgagaaaatgtataaaaccggagatttaggcaagtggaatgaggatgggaatatagaatttgccggaagaatcgaccgacaagtaaaaatcagaggatttagaattgaactggatgagattataaacagactgctgtctcaccgcaatgttcaagaagcggttgcgattgctcacaatgatcagatatatgcctatacagtatgtaaagatacgcagccgccttctcagctaaaagaatacttattggaatatctgccggaatatatgatcccgacagtcattattggcatagataaaattccgttgacgaacaatgggaagactgatgtaaaacgtttgccgcttccagctgaaaataatgccgagctgcatcactttattgctccgagaaacgagattgaacgaatcgtcagtgaggtttggtccgacattcttgaagtttctaaaatcagtataaaagataactttttcgttttaggcggagattcaattaaagccattcaagcagcggtcagaatggaaaaattcaatcttaggctggaagtgaaagacatctttcattaccagacaatcgaaggagtttcgaataaagtcagttatataacagcggcatctgataacagtgtgataacgggagaagcccgtcttgtgccaattcaatgctggctggctgaacgccataatgatactctgcaccatcggaatctttcttttatgctatacagggaagctgggtttggcgaagatattgtaaaagacattttcacccggattattcagcatcatgacagtctgagaacagtattcaaacgtaaaggcgatagaatggtacaggtaatcagaggcctgacggacggcgacttgtttgactttcatctgatcaatgcaataaacatgccgcaatcagttttaaaaatgaaaataaatcaaatacaagccagtatggatctgactcacggaccgcttgttaaattggcactcattaaggaagcagatggggaacatctgttaatcgtcattcaccaaatgataattgatcatatgtcttggagaatactgcttgaagattttaatacagcatatcagcaagttaaaagtaacgaagacattgtattaccaaataaaaccgattcgtatttaaaatggtctgattatctctataaatatgctgaaagtgaacggctgttgtttgagaaagagtattggacgaaaatcgaaaatgtttatgctccgtctattccggttgatattcaggggcaaattgccaaagtcaaagataacagacaagtgtacaggcagtttaatgttcgggaaactgaaaatataatgaatgcgattcaaggacaagatcatttcactattgagactgttttgctcacagctttaggtttgacagtaaaacatcaaacaggcagtaatacatctctcgtgcacttaggcaaccatggccgcactcatcagagtgagaagcttaatatctacagaacagtaggcagattttctgcaatctatccggtggctttggaggtctccgattctgatcatatcggttcgagtttagataatgttaactcgaccttagccaatattcctgatcaagggataggatatggtattttaagatatttaaaacaagatataaaagagaaatcaaaaccagacatttcatttaattatatgggcgaatttgataatgaactgcacacagaaagctttacggtatctccgctttcaaccgggaatgatataagtgaagatgaaatttggaattacaagtttaagtttattgtgttggtaagagagaaaaaattgagcattggaattgaatataatcaaaatcagtactataagagtactgtagaaaatctgctcaatcagtatatgcgttatatcaaaaaagcagcagaaaccatttaattaatcggaggttaacgtaaatgaccaattcagttcagcaagataaacaagtaccgaagaaatatcctcaggccgcagtcatgcaaatggtttcagggctggggttttccctggcagttaaaacagcggtagaattggatgtattttccgcttttcaaaatggaccagcttcagcggaagcgatagctgaagcccttgaattgaacccctctgccttattcaggctcttaagagcgctggaatccgtcggtttggtcgcccaagctcaaaatggctattatgatgtaacagagtatggtgccactttgatgcctgggaaagcaaaatcgattgagcctttggtagaatatctgctgcatgaaacagtagtgcagtctatgtttaaaatggattatagtatcaaaaccggcaaatccgcttttgaagccatttatggtgataaatggtatgaggataatagtcttgatcaagattacttaaaaacaatggataaggcgatggagatttattcaaaaatgagtctgccatccatattgaaagcttactcatttgaaaagtttgatgttatcgtagacgtcgcgggaggaatgggccagttaataacaggcattttaggtgctgctcctaaatcaaaggggatattgtttgatcttccaaaaacgatacaaagtgcaaaaaagcatttagcatcttcagagatgagcgaacgctgtcagtttacggaagggagtatgtttgaggaaattccttccggcggagacttgtatgtgataagcaaagtgttaaacgattgggatgatgagcatgtggttgctattcttgaaaatatagccggtgccatgtctgatcattccaagctgattatagttgaaaatgtgcctgaagcagacaggctgtcccctgaagaagcttttcgtgatttattatttttagtatgctctgcaggcggcagagtcagaaagaaaaccgagtttgaacaattgattgaaaaagccggattaatactattaaatgtaattcagaccccgagtaaatacacaattttggagtgtggaaagaaataatgttatataagctatctcctttaggagatagctttttttatataaaaagttcaccaatttgactgattgattctgtctatctattgatttctctgataaaatgaaacttataatatttaacataattataaatttgaaccacaaggaggaagaaacatgaaaaagagactcgttatgctatttgccgcggccgccgctgctttgttgcttgtgagcgggttgtgggctccgtcagcgtctgcggcgccggctcctgctttaacacaaatccgtattatcggtgtgacgtctgacggtcagaattaccaatgggaaaatatcgggccgaaccaaatcagcgcatcaaaaccgatgaaggggacaacgggttatttagccgtatatttccaagggtatccgaacaataactcgatccaggcgtttaacaacggaacgaatattacaaatcttacgtcaaaagcgctggaagatgaatatacgaaaaacggcaatatcgttacaggctatattaaatattacagcgttcctctttcttatgtcagttcaggaacgttctctttctccgcaacgggactgaacgggccgtacacgccgttaagcagcggatttttctccattcaggtacagagttaaaacagccgcccggtgctttcatgtatagtttttctctctttccgggaagctattcctaaagaaaagggagggcttacatgatggacaggacactcggatatttgcgcgagtcgctttcgaaccacttggagcatgatgtgtgccgggggatttataaaaagcttcaggtgaagcattatgcaaatgaaggcgagttcgtgaaagatctaaatgatctggaaatggatgcgctgaatcaggtgcttgaaaaggaaatcaaatatgctgagaacgagcaggatgagaagcgcacgatggaattgaatgaagtatatgagctcctgttttaaaaagcctcccggcggccgggaggctttttattgtttcggaaacagtttacagaatcatccaaccctttgtataatggatagttgtgaaaaacacagacggaggagaaacatgaacgaaataaaaaaacagacggttcttgagttgtcatcggttgaaaaagctttggtttttctggtgccgccattattagggctggtcatcggatggtttctgccggtcattgcgaagtgggccgtaacattggattggctgccttttcacgggccgctggaaataatcgcttcctttcacggatggaaggctgcggctgcaaccgccgttatcggcttaattgggggagtgtggctgacgcaggcagcttttaaagaaagtcttgtggcagtcgtgacggacagcgaggtgtccttaaccatatataatgaagaaagcgtgttttcgaaagaaagcatttccggtgtgtttacggatgggaagtatcttgtcttattaggcactgaaggacaggagctttttcgggagaagcttgagccggcggttgaaaaagcggctgaggcgtttcgcgcgcatgggtatgtctggctggggacggaagatccttttaaagaagaatacaaacggtgggtgccggacacgccggatttggagcctggggcaaatgctcttttaaaagcgagagaaaaggcgctgaaagaggaggaaaaggcagatgcgaaagagctgaaagcggaaatatccaaactgggcattaccgtgcgggagaaaggatcgcgccaatattggcggatctataaaacgccgtctgcataaaaaaagctgccgccgtttgatacggccgggcagcccgggaacagattatttcttcttgtcatcataatattgaaccgggtacatggagccttcggataccattttgttatcttcaatatcttcgggatgcgggttgcctgctttgttgacggggaatgattcaatatcctgcttcccggagagcgatgttttcatattgcggataaagttcatcaccttttggcggtttgatttatctttgagcaggtaggaagtcactccgacagtcgacacggcaagtcctgaaatgagcagtttttgtttcacgataaaaactcctttctatttctggcttgcagtagttattcccgcttaacggctgtttaaacatcggaaggttaattttggctttccgctttaatgcgataaagattgacaaaactattttcagaataatattataaatatatgatagcgctggagtcatattttaattgaaaggtgttaactttatgaatcaattacatcgcagaatgggaacgtttgcactcatgatggtcggacttgggtcgatgattggctccggttggttattcggggcgtggcgggcggctcagattgcgggacctgccgcaattatttcctggattatcggtatgatcgtaattttgtttatcgcactttcttacagtgaattgggttcaatgttcccggaagccgggggaatggtaaaatatactcaatattctcatggatcatttattggatttatcgcaggatgggcaaactggattgcgattgtttccgttattccggtggaggcggttgcgtctgttcaatatatgagctcatggccgtgggactgggcaaagtggacaagcaatctcgttcacaacggcacacttacgggagaggggctcggcttcgcatccgtattgctgattatttactttttactgaattattggacagttaacttgttttcaaaagcgaattcattgattaccatctttaaaattattattccggggctgacaatcggagcgctgctgtttaccggttttcacggcggaaacttcacatccggttcaagcattgcgccgaacggctgggcgagcgtgctgacggcggtggctacatcaggtatcgtatttgcgtttaacgggtttcaaagcccgattaacatggccggagaagcaaaaaatcccggcaaatcgattccgattgcggttgtcggttcgctgttggtcgcaaccgtcatttacgtcctattgcaaatcgcatttatcggtgcggttgaaccttccatgatcgttcacggctggagtcacctgaactttaactctccatttgccgatttggcgatcgcattgaatatcaattggcttgtcattattctttatgcggatgcgttcgtatctccgtcgggaacgggtatcacttataccgctacgacgtcccgcatgatttacggcatggaaaaaaataaatatatgccgagcattttcggaaagcttcatccgctgtacggcgtgccgcgccaagcgatgattttcaacctgatcgtatcgtttatctttctgtttttattcagaggatggggcgtgcttgctgaaatcatttccgttgcgacgctgatttcttatatcacgggtccagtgacggtgatgacgctgcggcggacggcggcggatttgtacaggcctctccgtctgaaaggcctcagcgtggttgcaccgctcggcttcgtgttcgcgtctctcgtgctgtattgggcgcgctggccgttaacagggcaggtgctgtttatcattttgatcggccttccgatttatttctactaccaagcgaaagtgaagtggaaaggattccgcagaaactttaaaggcggcgtctggatggttgtctatctgctcagcatgatggtcatttcatggctcggaagtgaaaaattcggcggtctgaacatcattccgtacggatgggatatggggctgatcgcaatcgttgcccttgccttctatgcgtgggcgctgaagagcggattcaagactgagtatttgaaagacgccaaagcaatcaacgatcaattaaaaggcggacaggcggaagccgccgccggaaaagaataatgattgttaaaaaccttgcggtaacgttcccgcaaggtttttttatcgggcaaaaaaacatgggttcggcatcatccccgaacccatgctcgctcgatacaggctgacgagattgagagcaagcctaacgacgaaaaccaaggccagtattcttttttttcatgatttctccgccttatcaataactgccttccatactaaacaatgaatgtaaaagatatgttgggcaactattaatcttttatgtttcttcttctccatgcttcatcctttttcctgtactcctaagtcaaagttttagagacaaaacaaataattaaccacagaaaaaattcagtacgtaagtttagattacaataattgtataatgaattaaaatataggagaataaacaaatagcacgaggtaataagtataaaaacgcgaaaattaggactgggcgtctaccctagagacatcagagattccggttatacaaaaactattaaaacaattagatgaattattttcactccctaagtttatttagggagtcatattattttaaggagtgagattatatttgaacaagattaagtggttaattataattgcggtcatagtattaataggtatatttatatgtatcggaacttttaaatatactaatacagtttctgatgttaaacaaactgaaacagaaaaagaaaagaatttcttgaatgataaaattgcagctatatattattcagctacaatagattaccctaaagatgggagttatactgtatatattgatgaaaaaggaaaagcaacagctgtaaaaggagatgctattgaagttggaaccattgcacaagatgaaaaaaaacatagttagacaggacaaaaaagaagtttatatgataggcgataactttaaaaaattcccgatgcagcatcaagtacatacaagttatgggcaatcatcaggccatttaataaaagaaaatatcttttattttttgaataatcaaggagtcggtgaaaaccattataatagtttaatcagatggggtaacagcagtggatttcatgaaaaagttattccgggtttctatacaagtaccggtaatgacggtgaatatatttacgtgataaatgaagattcttcaatcaaaacaccgacttttcagggtattaaaatagataaagataaagttacagttgggaaaggaacaacaattcctatattaaatgaagaaaattggagtgtttattcacagataatagttaaaaaaagctcagccttttttatactatataaccaaacggataaatcaaacaaagtacaattcaaagtagcagaaattgatttaaagcataataagtttaaaggtgcatatcctttaggcagttatcatatccctgatgaaatttctcagctggctattcctctttccactaataacttttttgtgaaaaatgacactttatatcatttggcagctaattcaatactttatactttcgatctgaaaagtatgaagccaaagaaaaaacttccattacataggtcaacaaaatttgaaaaccaagcaaaattcacttattttgacgagtctgaaattttcttgttagaaataagcaagggcgggaaatatgtgattaattcttactcttataaaaacggaaaaaaattaaaatctactcctatcagaggacttgaaaaaattattaacaatacccatgtttctgaatatgacttttttatgattaagaaaaacaaagaagtatggagtgattagatataaatggctagacagctgagtgagtatacttaaggggaaattaaattcacaaaggagaataataatggatgagctagatattgcttttggtattttaccactttctattattgtcttatcgattatattcacgtatattttcaaaaaagtgtatataatgccgcttgtcagcatagttgtttctgtcatactaatgtttactgtttttaatctatctttctggggatgggttgttgtctatggtttagtatcaataatattatcatatattacaaatagtataagaaagaaaatagataatagaaataaataattatattcctttgattaaaaaggtatcacaagtaattcatcattactgtgatacctttttacaattaaggtgaatctcagccttttaataacatgccccacccgctatataacccatgatggcgtttgcattatcgggcaaaaaaacatgggttcggcatcatctccgaacccatgtggtttattatttatattcttttttaaccttttggaatatatccgcatagttggtaaacacaccggttacgccccaattcagcagacggcgcatgtccgtctcgctgttcacggtgtaagggtgaagcagtaggccgtggctgcgtatgttccggacgttttgagcgttcagcgctttgtaatccggtccgattccgacggcatatgttttgatgtccgttaaatctgcgtcagtcattgacgtcatctgttccgcttcaagcaattggacggcgggaagtttcggatcgagctgtttgattttcagaaggctgtccctgctgaaagactgaatgatcacttgtccaagtttcgcatgctttcctgccaatttatattttttcagtgaagcgatcagtttttcttccatacccggatatgtttcaggcgcctttgtttcaatataatagtttgcatgtctgccgaaccgttttaacacgtcatcaagtgtgggaacgcgaagtccggcgtattgcggttttgctttttccggataggccttattgaaccaagaaccggcgtcgagcttttgaatctcggctaatgtatgatccttcacccagccttgtccgtttgtggtgcggtccagcttttcatcatgcatgacgatcagcttgccgtcttttgtcatttgtaaatccagctcaatatagtcagccttcattttttgcgcagtttcataagaaaggatcgtgtgctccgggacataccccgaagcaccgcgatgggcaatggttaaaattctgtcaggagacaagaggtttccttttcccgccgccgatacaggcgtgacgatgaatgacaataaaccgaatgaaagcaataccaaagcaaacaacttatgtttccgcatgttttcttcccccttaaaaatcaatatctgtctctagtgtagaaaatcgttgtaaatgctgtactgcaaaaatattaatcttttatgttgttttcttacacatgctccgcccgcttgcccgtattccacgtcatagccaagaagacgatggacagcacgcatgaggagataagcatgataaagccgccgttccagtcaaagcggtctacaacataacccatgatggcgttggcgaaagcagagccaccgatgtagccgaaaaacccggttaagccggctgccgttcccgccgcttttttaggcgcaaggtcaatggcctgaagtccgatcagcatgacaggcccatagattaagaatccgatgctgatcagcgcgatattatcgatgagcggatgaccggcagggttaagccagtagaccaatacagcgataaatacgccggccatgaacagcacgccggccggtgcgcggcggcttttgaaaaaccggtcgctgatccagccgcacaaaatcgttcccggaattcccgcatattcataaaggaaataagaccatctggagtcttcaggagagaaccctttcgcttccgtcaaataggtcggcgcccagtcaacgacaccgtaccgcacgaaataaacaaagacattggcaaatgcgatataccacagaaatttattattcagcacgtatttaaaaagaatttctttggtcgtcatctctttttcctggtctttgaacgcatgtttcggatagtcattccgatattcttcaatcggcggaagcccgcaggattgcggcgtgtcccgaacgagaagaacaatcacaaatgaaatgacaatggcgataatcgccggaaagaaaaatacgcttttccaagtaacaaacatggcgatgccgagagtcacgagcggggcgagaatacctccgcctatgttatgggcgacattccatatcgacattttcgttccgcgttcactgatggaaaaccaatgagccatcgtccgtccgcaaggcggccagcccatcccttgaaaccatccgttaataaacataaaaatgaacataatcgtcacgcttgacgtgacccatggcatggaaacaaataaaatgttgacgacacctgacaaaaacagacctgtcgcaaggaaatacctcgggttgcagcggtcagacaccatccccataataaatttgctgaagccgtaagcgattgatacggccgcaagcaccaagccaagttccccttttgaaaacccttgttcctgaaaataaggaatagcgaaggcaaagtttttgcgaagtaaataatacccggcatacccgatgaaaatccccaaaaatacctgcagcctcagccgtttataggccgcatccgtctttgaatcatccaatctctcaatatgcggagccggcttgaacaattgaaacatcatatcctcccctttgctgaacgtctatcatgatgtatgtatgactcctttccttgaaaatgacaaaaagaaccagaaatcacccttatgaaagggcggggtttcctggttctcctcatctccatccaaaaatcattaacttgtatatgatagcgctttcttaaattaccacagtctgacgtggatgtaaacgctttaaggaaagttttcatttttttgaataaataaccggagggaatatcagccggagcgcgaaagatttgaggtactcgattttgtactcaggcataagatgtgttaggccgaactaagaaaagcgaagggagtgcatctgttgattgatgaattggattttgcgttcggtgttctgccgctttgtatcatcatcctgtcagtcgccggaacgtacctgtttaaaaacgcgttcattatgccggctgccgctttggccgtttgccttatatgtacctttaccatattgaatttctcgtttatcgggtgggccgtcgtgtacacgctcgtctctttcgcgttatcgcatattacgatggtggtgatcagccaaaataaaaaataggatcggcggcagccgatccagctatcaaaagcagagaacacatctctgctttgttttatttatgaatgtgcaggaattccttgatgaccgcggtctgttcttctttcggatagcttctgtacagatggctggctaagcggacggggtcaccgaagaagtaccgctcatattgtgtctgccttgttccaaaggggctcatggtcaaatcccatgcgaggcggaacacttttacccggtcttcagcgttcaattcggccgcctgcaaatattggtcaaggtctcctctgatgtcggaacggaacgctttttcagtcggcaaagtcaccattccgcttgccccgatcagctggatgatttccgtgaagcgcgggtagatgtcagggaaaatcgcgctgaccacacgaagcggagtgacactcggacgcatataaccccattcgtctgtttccgcatcattctccgacttttccaaaagggctttcatcgtttccagaccggtgatgatctcagccatcttagcctgaatatgctgatattcgcctacatctatcgcatcgacaagcgtttgggcgaggccaaggagaaactccgtctttacaatttgtctcgtgataacttgatgaaatgcgaaggcgttaaaagagcttttcatattaaaatcaaaagccgcctcgtaattattgtaaaaaaatacgcgttcccaagggaccaaaacgtgatcaaatacaacgatagaatccatttcttcatatcttgagctgagcggataatcaaacgatgattttccgagtacgaaagattccctgcagataaattttactccctttgtattggaagggattgaaaaagcgaacgcttcatccgattcaaaatacatcttaggcagagaaaccacgagcacttcatccgtcaggccgccttgtgtggctaaaatccgcgcgccgtgtatgatgaggcctttttcatttttatcgacgacttttgccgagataggtgtcggcgatacgtttacgcccatttgtgaacgattcacctgaggggtgataaacgtgtgcgtaaaagaaagatcctgtgcggcagcgcgttcgtacagcgcttgaacatgttccggaaaacaatgatcgcggtctttcaaaagcgcggcagaggaggcgaagctcatcagcacggtattcatataatccgggcttcgtcccatcattccgtgcgtgtgcctggcccaatgttcgaacatgtttcttcttctttttacgtcttctttcgttttcggctgcaggtatgaaagcccggcccgttcttttttaccgggaagactgtaagtcatttgatctttcatgtccggtttcgtttgcaaatcataaagagagcgcttcgtttccagaaggcccttaaatgcgggatgttcagaaatctgtccctcgatcttttcaccatcaagccaaatctcatttccaagctgatttaatcggtcaatgaacattttgccattaatgatacccatcatgtcgcccttctttctttgcagatccactacctcattatattgaaaacgaaattgggtgttccggttatttccaaaggggaagagccttttttgataaggggggtgaagggattgcatcataaaaaaaaccccttaagcagaggggtttttaactgatcatgtctttgtatcgttgttcgaggacaaagtctatcattccggtgatacgggtgttttcagatttttgtctgaaacggtcagacacttggattttccttgaaaacggaaatacagcaaaaatccaaacaaggccggccaggccaaaaaccatctgcagaaccatttcaatcaattcattaaaatgagtgctgaaaaaaaagatatataatgtgatgaaagtgactgtacatacgattttgacagtatgtcggaatgtgaggggcggttcagtgaaacacattttcatttgattcagtgtgagcgaatcttgtttcattagatatgtaagcagttctttgtcattttgacttcgcggaatcaaatcattttctattctttgaacggtgtccttgtatgtctccatatcaatcttcatgcgaatcctcctttaaaaataactccaagaatactcattgagcattcctggagcaaggagctgcctgttcaattatagaaatagtgataaaactgtgctgaacaaggctgcagctcctcctaattcaggtgctaaaacgactaaagcaccgatccctacaataacaataattcctgcgcctgcaatagccatggtattcacgacagaatcccaatccggagagtacacctcttcggaatccggcagcctgaagctcttttgttttattttaaatgtaatggtagttgttagtccagttgtagcactgtcaccgaccggaatatcaggtgtataaattttaaattgaatattcagcgatcccgcagacggattgacatacacttctaaataaccgttgcggactgacaagctcagactgttaagcaggttttgataggaatcaatttgtgatgctgtaaaagagacttgtgaatctcccatcagaccggtaatataagctcccggtttgccgtttgtaatggtaactgtgttgggagaaccttcgcttggcactgttgccaaaagtgaagtggataaaagaatatccatttcaggtgatgtataaatggtttctgtcttgtcgaattcaaacatggcattcgcaagattcgatatattttctaaagcaggaatggttgttaaaatgtccgtcagtgtacgcagtcttgcatcatacacaggatcagaaggcggatggacgctgcttgcacccgagtcttttccggagtatccgtctttgtcaatggcgacttttcccgctccgcttccgatcgttccttcataaaattgatcaaaagcccagtttttcggcatcgggtatccgaggttgccgctgaatccggtcgacatgttagccgtaaagctatatttggtcagacctgcttctgacgtccggatacaaatgtttctcggcccgtataccccgatttcatatttcggcgcagttgagaacgcctgcattttcataaaagctgacttgatttcttggaagtaagggatgattttatccgtaacttcataatcatacgcatcgaaatcgacggcaaagtaaatggtcgttcctgacggaaaacctaatcttcgggcggctgatgcagcgctgtacgcatctctcgttccttggtcttttacaaaataagaagattcatagccgccgtcctgataaatcggaaacacgcttaagccggcattgaaaatcgcggaaagttcttttgacgttaacgctttcgatgtcagtccgctgctcgtccgcacattcccggtcagatatcttcccacgatcttatagccattctcacgcaaagttttagccgtatctgccgtcaaaatggcagcggtgtcacaagctgaagcagcccgtgttgtgtcgcctgagcttgataataaagctttaatcgtcggcatgtccgcataacctgtctgcggcagacacataaattcttggaaagctttcactgccgatacaactccgacgccgtattttccgtcgaattcaccggggtcaaatgatttcccattacagtaaagcgcgtattgcacaatcaaaacaaagcctgtccgtgaatcgccgggagtcaaggtaggacataagctggtcgttccgttcccgaaaaatccattggcgacgcttgtgctcatgccttcttctttttgcagagcataaatgagagccttgtttgtatcgcgggcatataagccgtcacaaggcatcaagccgatgtagtcattgtaatcccggttcaggttctgctggatctggcggattcttttgtcgcctcccgctactaaccgaaaagcgctcatatccagcaaggccttcataatgagtgccgtgacgatgccgtcttgcttagtgagcccggccgctttttgaaactcttttacagcgctttcggtattttcatagaaaacgccagaaaatccgcccgggttaaatcctttacaccacagcgccccctgcagaatgtaattcatgtttgtcggcttagaatcgggagcctgctttttcagcggtttaaacaatctttgtgtcgtcggtccgaagttatcggcgggttctgaaataccaagctcaatttgaagcgcccgtgtcagaccgtaaatggtatcccagcctgtttttccgttttccggcaccttgttgtacccgtgtctgcctttgtacgtctcattcagccattgttgtgtttccaggaccatttcgtccattgcaatccctccattatgtgtagtgtgcgttcattcataggtggcaaacgtatgacagtttgtcatgggtttatgagtttgttcaagcagggacagccccatcatacaatcgcagcacaaacgccgaaagagaggcattgataggaaaagatctctctatgacaattgatataaaaacagcaaaatggatagcggtttaaagtaacatcatcacttaatcaaaaataacaagaatcataagtagtagtcatatagtcatttttagggctgttcatacctcttcctgcagtcaaaatggttagttggacggatttatgattagctatattgtcattaacataaatagggtaaatagttacaggaaggaagggttttctcgatgaaaagcaaaaagatttttaagtcgctcatcattatttttactcttttaatcagcggaattggttttatgggtttttcttctccgcaaaaagcagaggctaaagactggcttcatacttataaaagcgggtatttcactaactatgtgatcaatacgtatcaccctaaattcactaagacgacaaaaaagtacagcttgagagccgtgacttttaaatccaacagtaaagggaagggcacgtataaaatatacgtccaaaagcaagtcaacggcaaaggtgcctggaaaacaatcaaaaccgccaatgcaaagaaaaatggaacgacttattttgaaacaccttcgttaaaaaaaggagattcatacagatttaaaatggtcaatcaaggttcgaaaaaacgtgtcaattatagtgcgagttggattgtattcgcttcataattttgattttcagcttataatgttttagctgccgcagctgcggcagctttttattttctccggagctcaaccgccagggagcccgcacctgtctcttcgggcgtacgtttgtattcaccgcatcattctggattatgcggaaaggtacatcgcttcaatgaaaagccgatcccgggtccttttgatttgtttgaaaatgttctgatataaaaaaggcgtgccgcggtgtaaaatggctatattgataaaaatggaggttcagatggatcaagattatatgactgagcttgtctcagtccagctgaagaaaatccggtcggagagaggctacacacaggagaaaatggcggatgtgatcggcctttctaaaaagtcgctggtgcagattgagaaagggcgggcgcttgcggaatggccgcacgttgtggcggtttgcgcgcttttcagatcaagtgaaacactgcaatccgtattaggagatgatccgctggaggtcattgaaacggttgctcaccgcacaattgacaggccgaaggggaagacgatgggcggcaaggtgtggtggaaagccatcgagaaaaaaggcgagttccgcttgcagcagcatttgatttcccaccattaccgcatccttgattcttatgatgatttgtggttcagcagttttgaaaaggcagaggctttggagcggcttgatgagctgtttttggaggcggaggaagcgaagcgctgacgcacctccggttgatgtattttctgacaagtgagaaaatatgtataaattccagccaaaggagagattcgaatgaagcctgaagatatcgtccgaagcggcccgaatcagtacatatgcaaggaaggaatcgcaaaagaacttccggggctgctggagacattcagaaaacccgttattgtgaccggaatcaaatcttatcaggcgttctccgattacggcggcggttcttcctgggatgtgattcagcacaacggatactgttcacctgaggcggtgcgtaaggtctgtgagcaggcggaagacgcggatgtgatcatcggtatcggaggcggcacgattttggatttggcaaaagcggcggcagaccggcttgatattgaggctgtgatggttccttccattgcggggacgtgtgcggcaagtacgccgttgagtgtcatatatgatgagagcggcaattttatcagagttgattatcacaagcgttcaagctatttgacgcttgttgatccgctgtttttgctttcctctcccattgaatatatgaaaagcgggatcggtgatacgctggcgaaatggtatgaggccgaggcggtcatcagaaatacggaggaggcgccgccgctgatggcgcaggcggggctgagacaggcggaatatatccgtcatctgttattgcgttacagtgaagccgccgtcgtaagcatggagaaaggcgagctgtccgtgccgttcatccatacggcggaaacgatcattatgcttgcgggaacggtcggcgggtatggcggccgtttgtgcaggatggcaggggcgcatgcggtccacaacggcctcagttttcttcaggagacacatcaggtgctgcacggccagaaggttgcttacggcatattggtgcagctcgcgcttgagaatcggagacatgagattgaagagctgcttccgttttaccgccggctcggtttccccgtcagtctctgtgatctcggcatccttgacaaccatgaggaagcaaagcgccgcatcgcttctcacgcctgccgggcggaagaatcgttatgcttaatggggcaatattgcgagaaggacgtgtcagcggcgattgaatcgctcgaatcagcacaaaagacaggatagagcttgtaatctgtcttgtctttattttttgaatatttccgttataatgagtggggtatagaaagggaggggccaaaggacatgtatcaggcgaagaagatgttgttattaggatcaggcgagctggggaaagaagtcgtcattgaagcgcagcggctcggggttgtcactatagccgttgacagctatgagcatgctcccgccatgcaggccgcgcacaaaagctatgtgattgatatgcttgataaagcgcaggtcagagaagtcattgagaaagaaaaaccggacctgatcgtgccggaagtggaagccattgcgacggatgagctgctgaagcttgaggaagaagggtttcacgtcattccgaatgcgcgtgcggcaaagctgacgatggaccgtgaaggcatcagacggcttgcggcagagacgcttcatcttccgactgccggctatgaattcgcgaatacatatgaagaatttaaagaagcggcagaaacaatcggctttccgtgcgtggtaaagccgctgatgagctcttccggaaaagggcaaagcgtgtgccgctcggcttccgggctgaaaagctgctgggacatggcaatggaaggcggccgggtgaaaaacggccgggtcatcgttgaggaattcattccgtttgaatcagaaatcactcttctgacagtgcgcgcggcgaacggtacgtccttttgcgcgccgatcggacatgaacaaaaagacggtgactatattgaatcatggcagcctcatcatatgacggaacagcagattgaagaggcgaaacacattgcgaaaagcataacggacgagctcggcggatacggtttgttcggggtggagcttttccttactgaagataaagtatatttcagcgaggtgtctccccgtccgcatgatacggggctcgttacgcttgtgacgcaaaatttgtcagagtttgcgctgcatgtccgcgcggttttgggattcccgattccggaaatcactcagctgtcgccgggggcaagccgtccgctgaaggcgccaaaagagtttgctgattatgcggttgaaggtttggagaaagctttggcggtaaaaagcactcaggtccgcgtattcggtaaacccgtcacgaaagtcggacgccgtatggcggttgcgctttctgcagccgagaccgttgaagaggccagagaaagagcggccgaagcactcagtcatttatcaattacataaaatgatcttaaaaggcgttttaccgtaatggtaaggcgccttttttgtttggacagactatatactggaaaacggggttgtgagataatgtatgaggccgttttgtgccggctttttaattcttgaaactttttatgtccgcaatcgttatatgtaatgttctcatttcccggagaaggaaataacaatacatcatacggcttttcattcatcaagaacggacaatccggatcgcagcatggaatatttaagcagggtaatccggaatagaggaaaccatgattgcttaccttaatatgaacggcgaaaaaacaaaaatcaccagattagattgttcaaataacaccaaatgctgtataataaaagaatttgaatgatagcattgaaagaatttcattttatgtttccttaaaatgtattctttatgcatacgcagtccgatttgatatggttttaattggaggtttgtgtaaactgtgaattatatacctagtatgattacaattggaaatttcatttgcgggctcttatcgattcattcccttttgtatcataatatacactctgcggtgatctttattttcaccgggatgtttcttgatttctttgacggtttggccgcccgtaagctgaacgcggtatcggagatgggaagagagcttgactcttttgctgatctcgtgacgttcggcgtagcgccgtccatgctcgcttacagtgtttcactatatacgcttccgttcatcggaattttaatcgcgctttcctacagcatctgcgggatgatccgtctttccagatttaatattgaacaaagcaagctgccgacgtttatcgggatgccgattccgtttgcgggtatgtgtcttgtcattttgagctttatcaataacgcttttcttctgggggcgggaacgatcgcgctcggttatttaatggtcagcaacattaaatttccgcactttaaaaaacaggcgcctgaaaacctggagagcagaagatggaattagttcagcaattaatatccgattacggatatatcgcgatttttcttatgctgacactcggtattatcggattgcctattccggatgaagtcatgatgacgcttgtgggctacttcgctcatttaaacgtgctgaattacgggctctccattctgatcagctttatcggagcgctccttgggatgattatcagctacttcatcggcagaaaagccggccgcccgtttattaataagttcgggaaatgggtcggcctgaaggaaaagaggatggagaaagtagacaggtggatgaagaagtacgggccgtacaccattattttaggctatttcatccccggcatcagacacgtgacctgctacttttccggaatcggcagaatggaattcaaaacctacttatgcttcgccgccatcggagcgtttttatggtgttttatttttattactataggaaaattcataggagtaatcaatgtttaatactgccgctaaagttctttaccgttcattgattgaactgactaataatcgattgacgtcttatctcattaaaaacttctgtgaatcgaaactgagcaagccgatgattccgctgttttccaaacactatcgcattaactggaatgaaacggaacgcacggcttctgactttgattcactggcgtcatttttcattcgtgatattaatttgaatctccgccccgtggcaaaagagaagaacgccatcgtcagcccggtggacggcgtcgttcagacggtgggcatgattaatcccaatcaaactttcatggtaaaagggaaggattattcgttcgctgaactgacggggtttaaaagcgccgatcacaagtataacggcgggtgttttgccgtgctttacctgagcccgagacattaccaccgcttccattctcccgtcagctgcacgtatcaaaagctggccgagctggggaaacgctcctatcccgttaatacgatggggttaaagtacgggaaagatgtgctctcaaaaaattaccgttatgtgtacgagctgacccgtgctgatcagcagatgctcatgattccggtaggtgcgatgaatattaactcgatcgttcagacaaacaccggaaaccggcttgagacgggggaagagctgggctatttttcatttggatcgaccgttattttagtattcgagaaagatatgtttaccccttcggataacctgactgaaggccgtgaattacaggtcggtcagatcatcggttatgcggagtcacaggaggaggcgtccgctttataaaagctgctcctcttttttatatggtgtaaggaagtgaactttatggaagaaaaggatttgggaaagctgatagaacagtaccggcatacaggcgatcagcaaattcttgaagcggtgcgggatgcatgccggcctgttgttgaggcgctcatctcagaactggctgaagacagcgccgatcttctgcgggcaaaaggccgtgaccgttttccgtttattatcggcaagtatcagaccgcggccggcctttcgcttgagacctttttgcgcaatacgtatcggttttattttcagcaggttttaaaaggcgaagcgtgactggaagaaagagtacggacggaaatgttcatctttcgcccgttttcctgtatgatatagtatagtgtgcgtgatcattaatataattgaacagggtgtataaatcatggaaaaacaatatagagttttactttattataaatatgtaaagattgatgagcctgaagagttcacggctcagcatttgaagttttgtaaggagctcggtctgttaggccgtattttgatttctgaggaaggcattaacggcacggtgtccggaacagttgaacagacggatcaatacatgaatgcgctgaaagctgatccgcgttttgccgacatgccgatcaaaattgacgaggctgacggccatgcattccgcaaaatgtttgtgcgccataaaaaagagctggtgacgcttcgtctcgaagatgatgttgatccgaatgtcacgacgggcaagcatttgaaaccgaaagacttttatgagcaaatgcaggatcctgacacgatcgtgatcgacgccagaaacgactatgagtatgacctcggtcatttccgcggagcggtcagacctgatattgaggcgttccgtgaactgccggactggattgaagaacacaaagacatgcttgaaggcaaaaaaatcctcacgtactgcacaggcggcgtacgctgtgagaaattttccggctggctgctgaagcagggctttgaagacgtgtcccagcttgacggcggtatcgtcacttacggtaaagatcctgaagtgcaagggcagctgtgggacggacagtgctatgtgtttgacgaaagaatcagcgtaccggtcaaccgcgtagagcacgttatcatcggaaaagattatttcacgggcgagccgtgcgagcgttatgtgaactgcgcaaatccggcatgtaataaaaaaatgatctgcacacctgagaatgaatacaaatacatgcgcagctgcagtcacgaatgccgtacgaacgaacgcaacatgtatgtgaaagagcacgaaatgactcaggaagaaatcaatgaacgccttgctttgattgaaaaagaggatcatggggcgattgattaatagaaaagaccaccaatgaggtggtcttttttgtgtttacatactttctgtccgtgcggtctggtctgccgtgacaggtcctttatatttgaaagctttttcccatttggatacgacgatgcaggcgaccgcatggccgggcacgttgacaccggttcgcgccatgtccatgacgcggtcgacaccggcaatgatggcgacgccttccgcggggagaccgaccgcattcgctgtcgccagaagcacgacgagtgagcctgacgggacggcggcaatgcctttgcttgtcatgacgagcacaagcatcatcagaagctgctgagaaagcggcatctccacatgaaacgcctgcgccaggaaaatacaggacaccgataaatagaggctggagccgtcacagttcagcgataaacctgacggaaccacaaaggagacgacccgcttcgggcagccatatttctccatccgatccatcagctgaggcagaatggtttctgtgcttgtcgtggaaaaagcaatcaaaaacagatcccaaatcattttcagcacttcaaagtacttgattttaaagataagccccacgatcggaaacagaacaaaaagtatcaggaacagcccgagaaacacagtgccgatcagcttcagcatcgggagcaaaagcgcgattccgaattgcccgacggaggcggccatcagggcgagaacgccgatcggagcggtgaccatcaccatctgcgtcagcttgaacataatatttgccgtggattcaaagaaattcatgacaggtgcggaggctttgccgatgccggctgcggcaacaccgaataggatcgcgaaaaaaatgacggcgagtagatcatttttcgccataacgtcaatgatgttaacggggataatatcaagaagcatttgtttcaggtcgactactttttccgtatagccggaaagctcgtgaatgtcttttttagcaagatgagagaggttaagtccgactcccggcttcagcacgtttgccaataacagaccgagcgccagaacgagcgtcgtaatcacttcaaaccaaataatcgttttgatgccgagactgcccatttttttcatactgccgctgccggcggctccgataacaatggtcgaaaacacgatcggcacgacaatcattttaatcaggcggataaatccgtctccgacgggccgcagcgccatcccgaaatccgggaagaaatggccgatcaatgctccgatggctaaagcgatcaaaatctggaatgcgataaattttttcaagcgaatcccccttttacttgcgcatttcttacgtaattcgtgaagcaggcggcaaccaccttcctctccgccataaatttgtcacattattgactgtgcgaaaggaaggattgctttacattatgtaagcgcaatcattgaatatgacagaaagtccgcattggaaaaaaagaaggagcataaaaataaagaaagatttctgctgaaaatattaaaaattttgataattatcctcttataagtggtatatttgatatgatatggtcaactgcattctcatatatctgtgcatacaagattcgggacagaaaaaacatgcagctcagaaaagactgaaaatttaaacaattagaagaaaggtgtgcttttgttgaatcaactgattgaaagacgtaaggtcacagctagaaaagaaaaaccggattccgcttcattgggatttggcaagtacttcacagattacatgtttgtcatggattacgaagaggagagagggtggcatgatccgagaatcacaccttatgaaccggtccatctggatccttccgcatcggttttccattacgggcaggccgtatttgaagggctgaaggcatacaggtcagaagacggacgggtgttgatgttccgtcctgaccaaaatataaaacggctgaataaatcgttacggcggatgagcatgccgcctcttgacgagaagctggcgctggaagcattgatacaattggttgagctggagcaggaatggataccgatagaaaaaggaacctctttatatatccgtccgtttgtgattgcgactgagccttctttaggtgtccggccttcaaagcgttacaagttcatggttgttctgacgccggtcggttcgtattacggcgatcagctgaaaccgatccgcatttatgtggaggatgagtatgtgcgtgccgtcaccggcggagtgggcgacgtcaaaacgtccggaaattatgcggccagcttacaggctcagcggaaagccgaagaactggggtacgatcaggtgctttggctcgacggggtggaaaagaaatatgccgaagaggtagggagtatgaatatctttttcatcataaacggagaggccgtaacgccggcgttaaacggaagcattctcgggggcatcacacgcgcatctgtgatagagctgttaaaaagctggggcatccgtgtcagggaagaacaggtcgccattgatgacatctatgaggctgcaatgagaggcgaggtgtcagaagtattcggtacgggaaccgcggccgtcatctcgccggtcggcgcgctgcacattcacggagaaacgattgagctgaataacggtttgatcggtgaagtgtcagaaaagctctatgaaacgattgccggcatccaagtcgggaaggtgcgggattcgttcagatgggtggttgaagtataaatgaaaaaagaacccttgcgccgcagggttctttttttggttattgggattttacggcttgcacgcgggctctgcttttccggtttttcaagtaataagcggtgtagcaaacggccataaaggcaattccgcaataaagggcgatggcctggttcggatcaaaagcgatgccgatacaggaggcgaggcataggagaaaggccgctatcggtacggccggatatcccggcgtcctgtatttcaagtctgaaagctggtgcccttctttaagaaaccgtcttctgaacaaaaattgcgaggcggcgatgctcatccacacagccactaccgcaaatcctgagacagagacgagaacaagatagactgtatccgctgcaaatacgcttgacaacaatgacagaatgccgccgatcatactgaagatcagagcgttaaaaggaatgcctttagaggtcagcctggcaaaggcgggatgaagctccccttctttagacagggaccacagcatacgtgatgacgcgtacagccctgaattggccgcggacagaagcgccgttaaaatgacgaaattcatcagatcggccgcataaggcacgccgactctgtcaaataccgtgacaaacgggctttcaatcacaccggcttccttgatggagatcatccctgacagcacaaaaatcgttccgataaagaaaagcgccagccgccagactgtggtcttaatggcgcgcggaacggttttttccggatcggcgctttccccggcggcgattccgatcaattccgtccctgaaaaggcgaagtttactgaaagcatcgtcatcagtatcgggaaaaagccatttggaaaaaggctgccgccatccgtaaagttcgacagcataggtgcggcctcaccgcttttcatcgggacgaggccgaacatcgccgctccgcccaataaaataaacagtaagatggctaagactttaatgcttgagaaccaaaactccgattcagcaaaaaatttcacggagaaggcgtttaataaaaagatgaaaagagcgaataccgcactccacatccaaactgaagtatgcgggaaccagcgctgcatgaagagcccggccgccgtgaattcagagcccagcgccaccgcccacgtcagccagtacagccatgcgaccgtaaagcccgtcgcgggcccgatataggtcttcgcataggtgtggaatgcgcccgtcaccggcatggccactgacagttcaccgaggcaaagcatgacaagatagacgatgcccgcgcccaaaaggtaagcgaaaatggtgcccgccggacccgcctgatgaatggtatacccagagcttaaaaacagccccgttccgatcacacctccgagtgatagcataaagaggtgtctgcttttcatacttctctgaaaattcgtctcgttcttgttgttcattgttttccaactttctgcgagggccgttctaataaaaaatctcatgccggcgaacggcacgagattccggcgaaccggctttttgaatagaatatacaaactattccgattagtcaagttgtttttaaggttttggcccaatcggcaatggcttggatgtccgcgggtttcgtccggcagcagcctccgatcaggctcacgccgttttcgtaccagctttgcgcgctttttccgaaatggttttcgcacgctgcgcctttccaggtttttgtcaccgggtcatattgttcaccggagttcggataggcgataatcggtttggatgctgcccgtttgatttcttctatcagcggcggaatatgttcgatcggtgtgcagttgatgccgatcgctgcgatttggctgcaggagtcaagcagggccgcgcattcggaaataggcgtgccttcgctgatatgccgtccgtctttagcgctgaagctgatccatgcataagtgccggggaattcctccagcagccttgtgatcgcttttgcttctgacaggcacggaatggtctcacaggccaaaagatcggcgccggattctatgagggctttcatccgggggcggtgaaagctgatcagctcatcttccgtcagtccgtaatgcccgcgatattcagagccgtcagcgaggctcgcgccgtaaggtccgatagaagcggcgaccaaaggtttgggccggtgtaaacggttttcttcatgagcccaaaattcatcgcgtgcttgtgcggcaagttcaacagatgtctgaatgagacgtatcgcatcggtttccgggatgccgcgcgctgcaaatccttcaattgtcgattgataactggcggtgatcgcgcaatcagcgccggcggcaaaatattctgcatgcacctgtttgatcagttcgggtctctccaaaagaattttggccgaccacagatcgtcatgtaaatcacagcccatccgctcaagctcggttgccatcgcgccgtctatgatcataaccgggtattcatttaatatttgtgtaatgggattcataggccttcctttctgactttactgaaaatatataaaaagggtaatggacgctattctctttgtcaatgaaccggcggaaaaaaggtgttcaggacgctgcccgaacaccttttgtttaggaaatgtttttgcctttcgcgcttttcgcgatatctgaatactcccagcattcgatcccgtcatcatcagggagcacatctctgtaaaagacggggtcctttccggctttcttttgccgggcataatcgctcaaagcggcaaacgcttttttcgacagaaggaaaatcgcgattaagttcacgaccaccattaaacccatgaacaagtcagccatatcccacacaagctggactttggaaatacagccgaacagtaccattccgagcacgcagatacggtaaatgaacagccattttttgttctggcttaaaaatccgatattggtttctccgtaataatagttgcccatcagagcgctgaagccgaacaaaagcattaagacggcaaggaaacctgacgcccacgcgccgacatgatcgctcaaggcagcctgagaaagcgcgatgccgctcagtcccggctggtgataagcgtctgaaaataaaatgataagcgccgtgcttgtacaaatgacgagcgtatccgtcaggacgccgaatgcctgaatgagcccctgtttcaccgggtggctcgtcgtagctgtcgccgccgcgttcggagcgcttcccatacccgcttcatttgagaaaatcccgcgtcttacaccttgcatcaaggccgcacctaaagcgccgcccgctgcctgatcaatgccgaacgcattttttacgattagcgacagaacgccgggcaattgggtgatattcgtcagaatgacaaagaaagcgacaccgatatataaaacggccaagacgactacgatgtattccgccattttcgcaattcgtttgacgccgccgaagattacgccgccgaaaaccaagattaaaataatgcccaatgtaagccggctggtgccgaatgcgttttgaaaggcgacgctgatcgtattggattgaacggaattaaaaacaaccccgaatgacagtgtgattaatacggcgaacagcgcgcccatccagcgtttcttcaggcctttttccatgtaataggcaggtccgccgcggaatccgttttgatcttttactttataaatttgggccagcgtgctttcaacaaagcttgaagccgaaccgatgactgcgataatccacatccagaaaatagcgcccggaccgccgagtgcgatcgcaatggcgattccggtaatattccctgttccgacacgcgccgccatactgatgcaaaatgcctgaaacggggaaatgctgttttttgtccgggcggccgcgccttccttcaaaacccggatcatttccttcagcatgcggacttgcagaccctttgatctgaacgtaaaaaacagtcccagagaaagaagcagtacgattaacagttttgaccataaaaaatcatttgccgagccgattacattttcaaggaattcctgcatccaatcacctcttggttcgtttgattaaaaaatactgagctcccactcctgtgcgatatgtttcagcagcatgccgccggtcaggctgttgccgtattcatcaatggccggaccgtaaatgccgatgccgcagccgttatgaaaaggctgctctcttctggcgcttgggggaaccaatgccatgatgccgccggataccccgcttttggccgggacgccgacgaaagccgcatatttgcctgacgcattgtacatcccgcacgtcagcatcagggctttggcgagtttcgcgacatctttcggaatgacctgttcccgtcggatcggatggtagccatcatgggcaagtatcaatccgattaaagcgatgtcctcggttgtactctccatggcacactgctttaaatacacttcaagcgtttcttccacatccgcctcgagaaagttcgtttcttttaaataataggcgagcgctcggttccgatgcgcggtctgccattcagaacggaagacctcctcgtgaatgtgaggccgtttccctattaatttttcaaaaacggaaaagagatattctaatttatcatgcgccgtttcacccggaagcagcgaggcgacggtaatggcgccggcattgatcatcgggttgaagggcttcccgggtttatggatttcaagccggatgatagaattaaacgcatcacccgtcggttccacgtccacacgatccagcacgtaagaaatgcctctggacatgcaggcggcaataaagctgatgacttttgagatgctctgcaatgtgaacgggacattccattcgccggcatgaatcattgagccatccggctctaatatgcaaatgcccagctgagagtcgttgatttctccgagggcgggtatataatttgcgctttttccattgacggaaaacggtcggtaatgctcgacccaatcttgtaaaagtgaagccagttcctctttttcaaggcgctctctgaccatatctttcataacattcctcctctattgcaagcctgtccgaagcggaaaccggtcttggaaaacgttttcaaaaatagcgtgttccatgttaatgtataatgacatctacagaatcatacaaaatacgacaaaatcattcttaaaataagccgatagatttataaatcagccggagtgtccggccattcgggtctaaagaaatttgcggactgtatcggtcttgttcaaaatagacagaagaaggaagtgattatgatcaggctcgactatttactgaaaaaagacggctatcttttcgctcttatgctgatcaccgtgccgctggcgggggaactgaaattttaccccctgaatgaggtatatcggatcagcttcggcgccccggcttttttcttttttcttctgctgcttcggcatgtgccggcggtattgtcagggctgttgacaggtgcagccgttgtgggattccggatcggcctggcgtgctgggggggagagcatgccggatttacggcggcttttttcagccaatatcccagtttctttttttactttacatatgcctgtttgttttatgtgctgaaggtcaggcttttttgggatcggccgctcatgatcgggtttctcggttttctcattgaaatggcgtccgatgccgttgaaatgacggttcagttttccggcggcaagcagattatgatgccggacaagctggcggatatcgcggttatcgctgtttctcacacatttattgtgctgagttttttcaacgtgatgaagctgcacgaatctcaggtcagggaaaaacaaacgagaaagcagcatgagcacatgctgatgattgtatctaacttatatgaagaaacgattcatttgaaaaaaacgttaaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaaggccgccgatctggtcggcctcgttatccgcatcaatgaaaaatacgccgaatctttaggcaaagacattcaattcaaaagcgtgattgaaggagaacaccccgattatcacgtctttaccgtcctgtcgatcttaaataacctgaccgccaatgccgtcgaagccatgggtgacaggggtgagatccgcctcgcgctgcgcagggctgagggggagatggccgaatttgaggcggaagatgacggtcccggcatcccggaaaaaatcggagaggtaatctatgatcccggatttacgtccaaatacgatgaattcggcacaccttcaacgggcatcgggctttcatacgtgaaggaaatcgtaaccgaacttgacggagacatttcctttcataacaagccaaaaggcgtcatatttacgattaagctgccggtgaagcatttgattgcagaaaggatgaactcataatatgcgtttttttatagctgatgatgaccgggcgatccgttccattttaaaacagatgattgaggacgaggacttaggcgaagtcgtcggtgaggcagaggacggaagccagattgaagggcattatctccatttcaaacaagtcgatattttattaattgatctgctgatgccgggccgggacgggattgagacgatacggcatcttcaggggtcgtacaacggaaaagcagtgatgatatcgcaggtggaggcaaaggaaatggtgggagaagcttattctctcggcatcgaatactttatccataaaccgatcaacaaaatcgagatcgtcaccgttttgcgaaaagtaaaagagcggattgaactggaaacctcgatcggcgacatccaacattcgttaagccgtcttattcagcggaatgaaccgaaaaaaagcgggccgggggggatgcacgagaaatcaatcaaagaaacaggaaaatttcttttgtcggaattaggcatcgtgggagaaagcggggcgcatgacctcatggccgtccttcactatttatttgaggatgaacaggcggaaagaaacatcccgtctttaaagcagatgtttacaaacgccgccattcggaagctgggacctgcggcggcacaagccgaggttaacagagaaatcaaagcctcggaacagcggatcagaagagcgatcattcattcgttaaaccatttcgcttcattgggcacaactgatttttcaaaccccaaatttgaatattacgcctcgaaattctttgatttcccagctgtcagcaagagaatgaaagaaatgcaggccaaggaaaccgtgccgctttctccggttaaagtgaatatgaaaaaattcattcacgtcttttttttggaggcgaaagatttacgcgaaggatcaaaatttgtcagcggaggcagccggtaagctgataaatagggtttacgtatataaggtttttgtgtaaaataatgttaactaagaaggaacggagggatcctgatggctgatcaaattccggttttcgcactaatgaaatagtgtcaaagtctctgccttgagcgcggaggaaaccgggattctctgcctgaataaggaacctgacagtaatagtgagggggcggcgattatgccgccctctttttggcgtcttcacacatctctttctcctccgcctaaaggcgaagctctgtgtcagtcaataagggaaatggggaaacgaaatgacaaaacaaagggaaatagaatccgttctgaacatcgcaaaggaaaatggcttacggttaaaatatgaaggggcggacataaatgaaacgggtatggacttccaagtcgtatttgctgaagatgacagcggcgtgacatgggtgctccgaaagccgcgccgtcccgatgttatcgaaagagcggctgcagaaagcgatgttctcgcgtttctccgcagccatgccgcggtatcagtccccgattggcggattcatacaccggaactgatcgcttatccgaaactggacggaataccggctgccgcaattgatctggataagaaacagtatgtctggaatatggagcacgagccgccttcagacggttttgtcggctcgcttgccgcggcattagccgggctgcacggggcagacccggctgcagcctccagatccggaattgaaattataaaaccggatgacgtcaggcaaagggcggcggaatcaatggatcatataaaaaaagaaatcggggtctcagagccgctttggaaaagatggcaaacgtggataaatgacagctcgtactggcctgatttttccgcgctgatccatggcgacttgcatcctccgcatattttgatcggcgaaaatcagcgtgtgacgggtctcctcgattggacggaggcaaaggttgccgatccggccaaggattttgtcctttatcaagtgatattaggagaaaaagaaacaaaacggctgatgaagagctacgaagctgagggcgggcgcgtctggccgaaaatgcaggagcatgtgacagaatggcaggccgcttaccctgtggaaacggcgaagttcgcgcttcagacggggcaagaggagcatatgcaaatggcgcgggacatgctcggcctgtccgatccgaaaggttattgacttccgccggatgacagcgtatgatacattttaaaatcatagaacggatgaacaatgctgaggaagagtaagtacgcatcagcgcgcggggttcagagagtcggtggccgctgtgaaccgatccccgtccggtgccgaatgggcttctgaattgctgcgctgaaatgacagtaggcggtgccgggattctttccccgttatcaagaaaggagtattgaaaccctgagtttctgtactttttgagagaatggcttttcagccgttaataaaggtggcaccgcgaaaacctcgtcctttgatggacggggtttttttgcgttgttaaggaggtgatggccatggaaagtgactggagacggacagacaatcaaaaaaggagggatattcatggtgatcgcaaccgacgatcttgagctcacgtgtccgcattgtgaaggaaccggcgaggagaaagaagggacgccctgtccgaagtgcggcgcgaagggcgtcatattgaccgctcaaggaaacacgctgctgcattttatcagaaagcatatggatcagtgaaatcaaacgaatatgtaaagaaacagcacaaaacaaaaaagcttgtagaaaaacatcgttttctctacaagctgctttttcattcttcaaaataaggattcacatggatgagcacttcttcaacatctgaaaagtgtcttttgatttcatttcggatttcccgggctatatcgtgtccctgcttaatcgtcaaatcatgatccaaagataaccggacatcaagcaatttataatggccgtgttctctcgctcggattttatcgagccgtttgacttgagggcaatgcaaaataaccgctttatattcctctatcagttcgggatcaacacttttttccatgagaacgtcaacagacggcctgattaattccattgaaatcttaaaaatgaggtacgccacgatgacactggcaattgcatcggcgtacaacagataggaccatccgcgtgtgttcccgataatcgccaataggacgccgataaaagcggcaagagaggcaacgatatcgcctttatgatcgtatgcaatcgctataatcgctttactgttccatttttccccttgtttgatcgaataacgatataagatctgcttagccacgtaggatatcagagccgcaaacaatgcgctgtattgcgggatgcttggaccttcaacaaaggacgaaatcgcttctatcagaatatacacggaaacgagcactaatatgattcctacaatcgcttcgctgatgacctcagctttgccatgcccgaaaggatggtcttgatcgggcggcttattagaaataccgatgacggccaggacagcaattgaagccacgacatccgctgcagaatgtataccgtcggcaaaaactgcttcactatcgcctatcagtccaaaaaagatctttcctgccattaagatcagattggctatcaatgcaatcaaagcaacttttttgcttatttgttctctttcacttgtcattttttcctcctataaaactgcacaaaaaaataggagcgcttttgattcgctctccgtatcctttcttgtgtaatcactttgcttatcatatcaattcagtttcgagtgggtctatagcaaggttgtttcctgtttactaataaataaggtgacagaaaaaaagttggagcagggctaaatagtacataaacaaaattgcgctgaatttaaaaatgaactgttgacatttgagtatttatcttttattattatcttgaattcaagatattttaattcaagataatttaattagagtgcaggataagaacctgccgatcgtttcgttttttgatcatatgctatttgattttttataccataatatctcgaattcgagataaaggggagtgcgagagaaatggctgaatttgtacagctggtgaatgaaagaagatctgcaagcaactttcttccagaacatccaatcacaagagatgagctcaacgaaatgtttgaattggttgcgttggctccatcagcttttaatttgcagcatacaaaatatgtgacggttcttgacccggaggtaaaagaaaagctgaagcaggccgcaaacggacaatataaagtgttcagctcatcagcggttcttttggttttaggggataagcaggcatatcagcaagcggctgacatctatgaaggattgaaggtgctgggggtattaagtaaacaagagtatgatcacatggttcaaaacaccgtttcgttttatgaaaacaggggagaactgtttaagagagatgaggcgataagaaatgcttcactttctgcgatgatgtttatgctgagtgctaaggaaaaaggctgggacacctgtccgatgatagggtttgatcctgaagccgtgaaacagattttgaatatagatgatcaatttgaggttgtcatgatgattacaatcgggaaagaaaaaatagaaagcagaaggccgcgcggctaccgaaagcctgtgaatgagtttgtggagtatatttaaatatttgtaaaggagcggataaaaatggctaaaaaaacgatgggaatccatcatattacagcaattgtcggtcaccctcaagagaatgctgatttctacgctggagtgctggggctgcgattggtcaagcaaacggtcaattttgatgatccgggtacgtatcacctttattttggggatgaaggcgggaagccgggaacaatcatcacattctttccgtgggcggacgcccgtcaaggcatcattggagacggacaggttggcgtgacatcttacgtcgtgccgagaggtgctatggcgttttgggaaaagagacttgaaaagttcaacgtgccatacacaaaaatcgagcgctttggagaacaatatatagaatttgatgatccgcatggcctgcatttagaaatcgtggaaagagaagcaggggaggccaatacgtggactttcggagatgtaaccccggatgttgccattaaaggctttggcggtgcaaccctgttatcagcacagcctgaaaaaacaggtgaactgctggaaaacatcatggggcttgagcgagtcggcaaagaaggagacttcgttcgttatcgttctgccggtgatatcgggaatgtgattgatcttaaattaacgcctatcggccgcggacaaatgggtgtcggcacagtgcatcacatcgcttggcgggctcaggatgacgaagatcaattagattggcaaagattcattgctgcgcacggatatggtgtgactcctgttcaggatagaaactattttaatgcggtttacttcagagaacatggggaaatcttatttgaaatcgcaactgatccgccgggctttgcacatgatgaatcacaagaaacaatgggcggaaaattgatgctccctgagcagtatgaaccgcaccgggcacaaattgaacaagggctgctgccgtttgaagtaagggaactagattagtcttaatgactgctgacgcatgaagaaaaagaaagagacatatattcaacagatgtttgctggaggcgactgttggtaaacaagctgcctgccttgcagcacatcatataatatgaaaaataaggagagataaaaatggaagatgcaggactattacttattcgaatcatgattggtgtggtgtttctgttttatggatcacaaaaattattcggctggtttggcggatacgggattaaaggaaccggacaatggttcgagtcaattggagttaaaccaggtaatgccgcggccgctttatcaggtctcggggaactcgcaagcggaattttatttattttaggtgtattcctcccgcttggagctgctatcataacaatcattatgttaggtgccattgtaaaagttcatggagcgaaagggtttgcgaacggtgccggcggttttgaatataacgtggtgctgattgccgtctccatcggagttgcactcatcggttcaggagcttacgctttgcatttttaatataagtatctaagaacagttactgaaaagcggtaactgttcttttatttttcaagcacgacgttaaggtgctctgaatcgcaaaaaagcggatatgatccatataaatgtgtatagtgaatgtacgagtattgatgagcttggtcatgaaagacgagccgatttgaaggagggttttgatgaaagagctgacagacttacattcattagattctatcgagaattgtattaagcagcatcaattcagttttatctacatttcaagacctgcctgtacagtatgtcacgctgttctgccgcagctcagaaacgtattggatcagtttccgaatatcaaattggggcataccaacgctgacgaggtagaagaggttgccggcagatttttagtcttcactgtccccgtgcttcttttgttcattgatggggatgagtttctgagagaagcccgctttgttcattttgaacagctcgaagaaaggctgaaaagggtttatcagttatatcaagatgtataaagtgtttatactttacaaataaaaagcccccctttaaggggctcaggctgtcgaggaaatctcgacagcctttattttccccttaaaatatccatttccctgtcataaaataaaagacccgcacaagagacgcttctcaaaacacagccgaattcgttctgtttgaccaactcgtcgaagaggatcacctgcttcgaaaaattgataaatacatagatgtcctttttctgcacctgaaatcaaatgaatatgtaaagaaacagcacaaaacaaaaaagcttgcagaaaaaacatcgttttctctacaagctgaaggccgttatccggccttttttacattattcggaccggggttctaaaaaacgggaccctcccaagtcttttctcatcagatagatatggaaaaaatattctccgacggcgatgatgacggcggaaataagagcggcaaacgccagtcttcctccggaaatgcccatggacagcggcattcccatcagccagacaacaagaaacgcgattccgaaatcagcggacgccgccgtgatattattccatctcggaagcacgtacaggtcgcccgtaaagtaggaaacggctcccagcacaatggtcatcagcagcacgtcgccgaatgtaaagcgaaaacctaagccgagtatcagatacagaataatgatggtcataatgcctttaatggcaagcgctttaatgtgttccatgcgaattcctccttatggaaatcatgttagtatgtttcctcataacgtgaaatataaacccttttttcgtgaacatttgttttctggcttttggctgtcatcactgggccgcggctgaatatgatgaaaggagaaaatacgggaggtgtcatgatggcagtcgtaaaagcgtcgagcgccgatgtcgatctaatggcaaggctgctcagggcggaagcggaaggcgaagggaagcagggaatgcttttggtcggcaatgtgggaatcaatcgggtgcgggcgaattgttctgattttaaaggcctgcgcaccatcaggcagatggtgtttcagccgcacgcgtttgaagcggtgactcacggatacttttaccagagaccgcgtgaatccgagcggaggcttgcccgcaggaacattaacggagaacggttttggccggctaagttcagtctgtggtactttaagccgccgggcaactgcccgcagacttggtatggccagccgtttgtcgccagattcagatcccactgcttctatcagccgacaggtgagacgtgcgaaaacgtatacaatacattttgatcccgggcgcaccgttcttaaaatgaacggtgtttttttaatgttttgtgaagaaaaataggaaaaaagtgcgcttgacggatgacaagccaaaaagaaacagagggggttttcttccggcggggcaaggtttgtcgaaacaatgtgaaaaatgtctcccgccgttcatttttcagccttacaaacccttcacacttcttcatagcggtttaacatttcttttttataataagggcgatcaataagacgaaaggggaactgacatgacacatgacggccgtttagatgaatggatcaaggaattggagaacaaaagctttcagaacaatacgtttgaccgccgcgcatttatacagggcgccgggaaaatcgccggtctttcccttgggttagcgatcgcgcaatccatcggcgcgtttgaagtgaatgccgctccaaaattttcaaactatccgttcaccctcggcgtagcttccggcgacccgctgtctgacagcgtcattctctggacgcgtcttgcccctgacccgctgaatgggggcggcatgccgaagcaggccgtgccggtaaaatgggaaatcgccgcagatgaacatttccgtcacatcgtcaaacacggaacggaaatggccaagccgaatctcggacactccgtccatgtcgaggcggacgggctcaagcccaataaagagtactattaccggtttaaaagcgggcatgagctcagtcccgtcggccggacgaaaacgctgcccgctccaggcgctgacgtatccgccatgacgtttgcatttgcctcctgccagcagtatgaacacggctattatacggcgtataaacatatggcgaaggaaaagcttgatctcgtattccatctcggagattacatttatgaatacggaccgaacgaatatgtgtcaaaaacgggaaatgtcaggacgcacagcagcgccgaagtgtacacactgtcagattaccgcaaccgtcacgcccaataccgctctgatgccaatctgaaagccgcccacgccgcatttccgtgggtcgtgacgtgggacgatcatgaggtggaaaacaattatgccaatgttatccctgaaaaaggccaatccgttgaagcgtttgtgctcaggagggccgcagcttatcaggcttattatgaacacatgccgctcaggcgcatgtcattgccgaacggtcctgatatgcggctgtacaggcaattttcttatggcaatttagcatcgttcaatgtgcttgatacgagacagtacagagatgatcaggccaacggcgacgggaataagccgccttctgatgagtggagagacccgaagcgcacattgatggggacagagcaggagcaatggctcttcgaaaatttagccgcctcaaaagcgaagtggaatgtgctggcgcagcaaatcttttttgcgcaatggaatttcggaacaaccgccaatccgatatacagcatggattcatgggacggctacccggctcagcgggagcgggtcatcaattttataaaaaacaaaaacctgaacaatgtcatcgtgctgacgggtgatgttcatgcaagctgggcgtcaaacctgcataccgattttaatcaaacgaattcaaaaattttcggagccgaattcgtcgggacttccattacatctggaggaaacggggcggataaacgggccgatacggatcagatcttaaaacaaaacccgcatattaagtttttcaacgattaccgcggctatgtccgctgtacggtgactcctgcccaatggagagcggattacagagtggtgccgtacgtgacggagccgggggctgaggtttccacgcgggcttcattcatttatcaaaaagaccagacggggattcggaaggtctcacaagcggcggttgcaggcggcttaaagcagtcaaatgaggtggaagaggatcgtttcttcgcccataacaatgcgcatgaaaagcaaatgagaaagaaacgggccaaaatctcacaataaggaggcacactcatgttttcaaatatcggcattcccgggttgatcctgattttcgtcatcgctctcatcattttcgggccttcaaagcttccggaaatcggccgtgccgccggccgcacgctgcttgaatttaaaagcgccgcaaaaacattggtctcaaatgaagagccggacaagcagacggctgagaaagacaaaacggcaggctgaatcctgacatgggggcagacgaatccgcttctgcctctttctctataaggaggatgtacgattggataaaaaagaaacccacttgatcgggcatttagaggaagtccggcagcgtctcattaaaaccgttatcgcctttctcgtgttttttatcggcgcctgctggtttgtacaggatatttatgactggctgatcaaggatttgcatggcaggctggccgttttagggccgagcgagattttatgggtgtatatgatgattgcgggaatatgcgcccttacggcagcgattccggttgcggcctttcagctctggcgttttacggcgccggctttgaccccgttcgaacgccgcgccgctttgctttacattccggggctttcgcttttgtttattatcggaatttccttcgggtattttgtgctgtttccgattgtgctcggatttttaacacaattatccgccggccattttgacatggtatttacggcgggcaagtattttacctttatgctgaatcttacattgccgttcggatttttgtttgaaatgcctctggccgtcatgtttctgacacggctcggaatcgtgaatccaacccggctggcaaaggcgcggaagctttcgtattttttgctgatcgtcgtctcggtgctgattacgccgccggattttatgtctgactttctcgtcatgattccgctgctcgtcctctatgaaatcagtgtgacgctgtcccgcatcgtttaccggaagaaatgggccgaggcgccgtctgcagcttagtgaagttcgcctccgccggtctcaatatcgtcctcatgcgccgcggcggtcaccgcggcgattttgagcgcttttgtcacgagatccaggctgaggctcggcgcagacttctgcaaggtttgctccggaatgtacgggatgtgtataaacccgccgcggatgtgcggatgatggcaggcgatttcatccatcagcccgtaaaagagatgattgcatacaaacgtccccgccgtgtaggatacagccgcgggaatgccttcctttttgatttcctcaacgatccgtttaatcggaaggccggtccaataggctgcgggaccgccttgagaaatgttttccccgacaggctggtttccttcgttatccggtatgcgcgcctcattcagattgattgcgacccgttccggcgtgatctgcattctgccgcctgcctggccgacacagatgataatgtcaggctgatgctttttgaccgcatcgcgcagcacggcaagagacttataaaaaacggtcggcacttgttcagatacaatagaggcggggccctcagcggcaccgttcagccgtttgaccgcttcccatgaaggattgaccgtttccccgccgaaggggtcaaagcctgtcagcaatacttttttctccatataaaaccctccttttctttttaccatactctataatggacatatattcctgccgaagggggaaacatgtcttgaattcgcctctcgtgcaataccgatctttatttccggcgctccgcacacatacgatgctcgccagctgctctcaaagcgctcttgccctgccggtttcaaaagcggtcaatgactatcaggaaagcctgcttcagcatggcggaaactgggaagaagccattggacgtacggagcaggcaaggtgtgaatttgcgaaattgatcggcgcccatcctgaagaaatcgccgttttaccttcagtaacggctgctgtctctgccgtcgtttctgctttaccggattgccgaaagaaacaggcggtgtatacggaattggattttccggcgatcgcccacattttgaaggcacagactgagatggagctttcagtcgtgccgtctgaagatggaatgatcccgctagagcggtatgagacgtacatatcggagcagacgcttttcacctgtgtgccccatgtgtcatatacgtcggggtttgtccaggatatgaagcgcattgccgagatatccgcaaagaagggatcgcttctttttgtcgatgcttatcaatcggcggggcacatcccgattgatgtaaaagaatggggagttgatatgctggccgcgggtgcgagaaagtatatgctcggcataccgggaacggcgtttctttatgtcagaaaggaacttgccgaacggctgaagccgaaagtcaccgggtggttcgggcagcagcgggcgtcgatgctggatttaacccgtttttcttatgcggacggagccaaacgctttgagaccgggaccccggcatttatcagcatatatgcggcacaggcggctttatctctattaaacgatgccggcacagaccgcattcaccgggaagtaaaaaaactcagcgcatttgcgtatgaatacgcttctgaaaaaggactgaatctcacagggccgccgtctgccgatgacagacccggcatgatttccatacgggatgaaaaagcggcggaaacggctgcgctgttgaggcggaaaaacatcgtatgcgcacccagcggacaaatcatccggctggcgcctcatttctataacacggctgacgatctgatctatgcgattgatgaactggctgaagcgcgcggtatataaaaaaaacagcagactcacggggagcctgctgttttcttatgaatgattcactttgacccgtttcataaagaaagcgctgatcaagccgataacggcgacaatcatcgcgaagataaaggcgtgctggacgcccgcaatcagcgcgtgagagtatgcggaaggatcattcgggtttttcgcggtgctcatataatttttctggccggccgccatgatgctgaccgccaccgcagtgccgattgcgccggccatctgctggagcgtattcataatggctgttccgtccggataaaattccggcggcagctgatttaagccgttcgtttgcgccggcatcatgatcatggaaatgccgatcatcaggcatgtatgaagcgcgacaatcagaagcgccgtagaagcgccgttaatgtttgagaaaaacgaaagcacagttgccgtgatgacaaacccgggaatgacaagccacttcggcccgtatttatcaaacagacgccccgtcaccggagacataaagccgtttaaaataccgcccggcagcaggatgagcccggacgtaaacgccgtcagcatcagtccgctttgtaaatacataggcaataggagcattgtcgataagataaccatcatacagatgaacacaatcacgacaccgagaacaaacatcggatagcggaaagcgcgcagattcatcatcggctgcttcattgtcagctgcctgatggaaaataagatgagcgcgatcgcaccgacagtgagcgaaccgataaccgtcgggcttgaccagccgtctgatccttcgcccgcattgctgaatccgaatacaatgccgccgaacccgatcgtagacagaataatggaaagcacgtcaattttcggttttgtaatgtcagacacgttctgcatgtaggcgatgccgaataaaagagccaacacaagaaacggcagggaaatccagaaaatccaatgccagttcaaatgctctaacacaagccctgaaaatgtcggaccgatcgcaggagcgaacatgatgacaagcccgatcgtccccatcgccgctccgcgcttatgcggcgggaagatgacgaggattgtattaaacatcagcggcagcagcagcccggttcctaaagcctgcacgattcttgccgccaaaagaaacggaaagctcggcgcaagcgctgcaatcagcgtgccgataatggaaaaagcgagtgaaacgataaacagctgtctcgtcgtaaaccattgcaaaagcagacctgataccggcacaagaataccgagaacgagcagatagcccgtcgtcagccactggacggtcgcaggagtgatatgtagctccttcatcagatcagtcagggcgatattcagcgccgtttcactgaacatgccgataaaccctgccgtcagcaaagaaatcatgatcggcatgactttatattgtttggaaggctgagcgttttccaaaatcattctcctctctttctatacgtacatgtctctcgtattttatgtcttcagcaggttggggatttgtttagaaatatggaggatcggcattttgtcttttttggctaaggacacaatgatgccgccttctatcatggcatttaaaacagtgctgatttccgccgctttctcatcagaaaaaccagctgatcttaatttgcccgcgaacagattctcccattcctgataagcgctttgacaggcctgccggagcttttcgctctttaaagcagtctcggcagccagtaaaccgacaggaaacccttcaaaattctccggacatgtgaattggcttgataagtcctgtaaaaacgcttgaatgctttccgcaggatcaggataggcatcaaggctttcttttattttcatacggatataatggctcatttcattgacagcctcaatggcgagctgctctttgccgtccggaaaatgatagtaaagagaacctttcggcgcaccgctttctttaataatctgattcagtcccgtgccgtaatacccctgaagctgaaacagcctggttgccgcggcgaggattttttcacgagaatctccatagctcataatgttcccaccttactgatttgtgacaaatttaaaatatagtgactggtctattatctggatttcgcatgacggtgtcaagaatttttaacggttattttcttcggaaggttgcctgacaagcgcgttgaccggtgagaggaaaatcttcataaataaagaaaaggagagaaaagaatgaaaaaacaattcatgcccttcattacatttatcacggctctgctcttcatcgcggccggctgctcccaatctcctcaaacgaaagaaacaccgccccagatggcagccgcagcctctgcgaaaaaagacggacttccgaatattaaaattcttgccaccggcggcacaattgcaggcgctgctccttcgaagacgtccgctacggagtacagggcgggggcaatcggagttgatgccctgattcaggccgttccggagataaaagaggtcgcgcatgtgagcggagaacaggttgtgaatatcggcagccagaatatgaataacgagacactgctgaaacttgcaaaacgggtaaacaagctgctcaagtctgatgatacagacggcattgtcattacacatggaacagacacacttgaggaaaccgcctactttctcaatttgacagtcaaaagtgacaagcccgttgttgtcgccgggtcaatgcggccgtccacggcgatcggagcggacgggccgtccaacttatataacgcggtaaaaacagcggctgcgcctgaggcgaaaggcaaggggacgcttgtcgtattaaatgacagaatcgcttcggcgcgttatgtgacaaaaaccaatacaaccgcgaccgacactttcaaatcggaagaaatgggttatatcggaacaattgccgatgacgtctattttaataacatcatcacccgaaagcatacgaaggatacagatttcaagatagataaacttgataaactgccgcaggtcgatattatatacggctatcaaaatgacggaagctatctctttgaagccgccgcaaaatcaggggcgcaaggcattatttttgcaggcccgggaaacggctcaatgtctgatgcggcgctaaaaggcgctgtaaagtcggtcaaaagcgggctggcggtcgtccgttccacaaggacgggaaacggaacggtaacacctaatcgagagtatgaaaaagaccatttgacagcttcaaactctctcaaccctcaaaaagcgcggattctgctcatgctcgcgctgacaaaaacgcatgatcctaagcggattcaaacctatttcaatgagtactaggagaagagaaccgggtgttctctcctttttcggtatgacgtattaaagcataagcgtgctttcgggaaaggggcgtctttctcattttttcgcctctttttcaattgttgaaaacagtaaaaaatacactattttttcctttccttctctaatagaatgaaaattgcaaaaatattacatagcaggaggaaagttcatgaaacaaatcaaaagcaaaatcctagcgattcttacagtttgcatgctgtccgtcatttccgtatttgccttccagccgaccgtatcgaaagcctcctcagggcataaccctgttgtcatggtccacggaatcggcggggcgtcctttaacttcgcgggaatcaaaacatatttggcatcccaaggctggtcaagaaaagagatgtacgccattgatttcttagacaaaaccggaaacaacagacacaatgcgccgagactgtccaattacgtgaaaaaagtgctcagcgaaacaggtgcgaaaaaagtcgatatcgtcgcgcacagcatgggcggcgccaacacgctctattacattaaaaatcttgacggtggagacaaaatcgcaaacgtcgtcacactcggcggagcgaacggccttgtgaccaaccgggcgcttccggggactgatccgaaccaaaagattttatatacatcgatttacagctcagcggacttgattgtcctgaacccgctgtcacgactgatcggcgggaaaaacgtgcagattcacggtgtcggacacatcggacttttgatgaacagccaagtaaacgggctgattaaagaaggtctgaatggcggcggacaaaatacaaattaacagtttcaaagcccccggagaatgagaatatcccggggtctttttttcttccatattcttttttcgccgtaaaccaagccctctgaagttatttttgttaaaataataaagttatatcagaattcggagggtttattgtgggaaaagtgaaaagaaatgccccttgcccatgcggcagcgggaagaaatataaaaaatgctgcggaagcaaagaagctgccattccggcagacatcgcggcaaaagaagcgaaacagattcaggaaagcttaatggagtacgcctttacagcacatagagacggcatatcatcatttattaaccagcatgagttcattacggagctggacagacagactaaagacatcggagtcttcaacctcggcatctggggaattttcttccgtccgctggcaggcggcaagacgatttttgaagaatatcttcagaaaaaagccggcggcatcaaccgcccgaaaacacgggaaatcgttgaatcatggaaaagcatgacacctgccgttatggtgcttgaagatgtgaaagaaggaatgattcactttgaagatgtgatgacgaaaaaacaattcaaagtggaaatggacgtcagccagcaggatcttccgccggcgggaagcctgattctcggctatccgatccacgaagcggaaaaagcggagttcttcatgcagtttacgatcttccctgtgaagcggaccgaagctctaatcagcaaagtgaaaaaggcggctgccccggcccttgcggaaggaaaatcgcctgagcgctttatgcaggaggacttcgacactgtgctggccgctcttttaggaacggcggaagagcctgagcaggctgctgaagaaaaacagacagagtgggcgaacgacatggagaaggaaacggcggacgctattgaaaaaggcctgagcggggatgaatacccggctgagctggttccggccgttattgacctgtggaaaacgttctgtgtcaaaaaaacaccgacgatcagaaagccggaagctttcgcggcggcggtcgaatattacgtaaacagtatttctctgaacggcgcgtccgtttctcaggctaagctggcgaagaagtacggcgtcagcgcctcaacgatttccagccgttataaggaaattgagggtgctctcacggatgaagccgaacgcttcgccgcagctctgacatcttaatacacagcaaaaaaaccttgaagggcacatgcttttcaaggttttttctgcagaaatgctctcggggcaggataattcttaccggttatctaatactaaacagagcgataaaaggaagggagcctgagccatggatgagacacgtacgctgggcaggacggatttacgggtaaagcgtatcggttttggcgctaatgcggtcggaggacataatctgtttccgaatcttaatgatgaaacgggaaaagaactcatccgcacagcgttggacggcggcgtcaattttattgatacggcgtttatatacggtttggggcgttccgaagagttaatcggtgaagttgttgcagagcgcggcgtgcgggacagcctcgtgattgcgtcaaaaggcgcgcacaaagaggtcaacggacaaatcgagctggacaacagccgtgaatttctccggagtgaggcggaaaacagcctgaagcggctgaaaacagacgtgattgatttgtattacgtccacttccctgacggcaaaacaccgctctccgaagtggcgggtacgctaaaagaactgaaggacgaagggaaaatcagagcaatcggcgcgtccaatctcagcttccggcaattgcaggagtttaacgccgacggttatttagaggtttttcaatcggaatattcactgattcagcgtgaggcggagcatgatctgctgccttattgtgaaaagaacggcatttcctttattccttattttccgcttgcttccggcctgctgacgggaaagtttacaaaagacacagtctttgaggacagccgaaagaacaggccgccgtttcagggagaagcttttcaccaaaacctggagcgagtggataagcttcggtccgttgcggaagaaaaaggggcgcagacagcgcatatcgcactcgcgtggcttctgtcgcagccggcggtggatgcgatcattcccggagccaaacgccccagccagctgaaacacaatctgggcgcgcttgatgtgcagttgaccgaggatgaggttcaatatatcagtgacatcttcaagtgaaaataaaaaaaggaaatagcctgcgctatttcctttcttgctgtcaggacgttttcaaaaacgcttctgtcaatccttccagatccgcgtctgtatccagataccactggccgcgggcgtttttcttcatctcgatttctcttgttacggaagaagaagccggtttcaggcgcataaactcttccggatagacagaaagcaggtggctgacaatttcgttttcatcagcatcggggtgctttccggcatagtcttgcacgcggtcttgcagctggcccgcaagcggagacatatcaagcggcgttacttttgcttcaaggacggcttttttgcctgacatggatttggtatgcaccttgagctctgtgttatcccgaagcgctgatgacatggcgtcaataatagcggaaatggcttttgaatccgcctgttcttgtgaaatgcctgcagaagcgataaagctggctttcgccgattcctgatatgcggcggccgtcattttttcatttacaccggtcaggcgggtgaaatctttattgtgcttgccgtacagcatcacatcaatgtatgcggataatgcgtccgccgggtcaggttttgcgtttgaggctgtgcctttgactttcagtttataagataaaggcttcgcgtcttttgcctgcggctgatataccaattcatatgatttgccttcgtcagccgtgaagtacagattgcccgtcactgtcttgcccgcatgaagcgtgccgctctgcatctggtcatccttatcggccgccgctgttttcgcgtcatcctgataaagcgagaagtcgctgcttttgacggtaagcgggtctttgcccgtatttttgacggtgaccgttactttcagcgcggccggatgttcagtatcgtctgaagcggcccatgccgtctcttttattttcactttcgccgtgctgctttcctggccgccgctcgtttcgctgctgcatgcggcggtaaatgccgtgagaagcagtatgaaaaacacggcgctcatttttttgatggacatctggtttaccccctgttgttataatgattaattcaatagtcatgaagacagacaggttaattatactagttttgtataaaagagtcttggtaatcatcaatctttttggaagaaaaggaagtgttatgatgaaaaaagaagaattgaaacagctggctctccggatcggaaacgtacctgcccgctacgagagtaatgtggaagaataccaggaagatgaggttttgttttggtgggaagataagaatgatccggaagccggcatcatggttgaactagaccgggacggaaaactgaaatccttatcccgtccggctttccggactgatctgccggctctttcggaatcggacatagaagaacggatgcgggcgtttttagaaacccatcgtccgggggcattggctgagttcgaattggaaaacagcggctccgccaatgatggtgatgtgagatattcctatgttcagatggctgacggtctgccgcttccgctgaccgggttttacgtcgacctgtctttgacaggggaagtaaccggcttttcttaccatgggaaggccgataatctcttaagacccggaacaattgcggacaagcgggaagcattggctcactttgtcaaacatattgaagcggagctgttgttcaccgtactgcatcagtccgtctatgtgcagggggatgacaagccccatctcgtctatgaaatcgtgtctccgacgcggccgatatcggctgacctgaaggaagagaatgcagaaatagacgaatatgaagagctggaagacggcacgctgccgtatgtcccgatttcatgccctgcacctgaagtggaaaagatgagcatcaatgacatgatcgggctgcacgacggtttttataaagagagggaaagcgatcttggggacggccgcatcggcattgcctggcatcctgaaaaaacaaaatccgtacggaaagataaaagcttagaaagtctgttaaaagagcggaatgaacatgtattgaaaacaatgcatgataaagaatcgggccggctcgccggagtgatgtcatttatacatagtgaaggcgaaccggagttttccgaggaagaatgccatcacatggccatccgctttttgttcgccatgtttccggaagcggatcagtatttccgggttcaatatgatgagccggatgatgaaggagaaaacgtgggacttacatataaggcttgttcgggcggcgttgatttgcgattcggagaggggagaatctgtgtcagcaaaaagacgggtcttgtcactgtatatatgccgccggaaattgatccgaaagagctcgaggaaatcgatcccgttccttcattgacaatggaagaggcgaaggacgcgatccgccgggccatcaaagccgagctcgcttgggatcgttgttacgaagacggcagctgcggaaaagtgtacaggctcgtatataagccggttttcccgcggtttattgaggctcatacgggagaagtgatcacgagtttaataggctgaaggtcatgggcgttcgtcccgggtctttcatgggaaatgtgacttttgtatgggaaacaaccgctctgaatacggctcttttccctctttgctaaaaatagacacataaaaggcactttcttccctttaaaaggataaggacgtttttatataattaaaaacagttcttttttatacactcttctgaaaggatgaccccattgctgaaagaacatctgagaaaaaaagcgctggagatcgggaatataccgccgcactatgagcttgaaatagaagattatgatgaaaaacaaaaaacgagagcctattatatatggaaagatcgtaaccatccggataaaacggtaacgattgagctgggcgacgacggatctttgcttacatactcacgcaacgactgtccgggttcagacatgcagctgtcagacgccgaattaaagctgacggctcttcggtttgcggcgagacaccgcccgcttacttttatgaatttcatctttcaggcgagggaagaacgcaatgggtgcatccgatttatctatacaaaaaaagtgctcggccggccgcttcccgattcaggttttttcgttgatgtaaccaggagcggcttcgtcgtgcagtttatctattacggggataagggtgaagcgcccgtcccggaaacattcgtcgatcgggaaaaagtcgtctcgcattatatgagtgtgctgacattcagtctcgtctatgatgtggtcaattttgagaaaataccgcgtctcgtctatgaaccgattctgccggcttacagctatccggccggtgaagatgatatcgtgccggatcagcagctttgcgaagacaggaatgagccggcaaaaccgcttcccgcgtttgaacataaacgggaaatcagcctggatgaattaatggggtttacctcggatatggttcagacgcgccggcgcgatctcggggatgagatcggaacgacatggcggaaagggtcggttccggaacggaaagatttgagtatcgaaagctattttgaaaccagcaacaaaaatacaatgaagatgaaaacggacaaaaagacagggaaaatgacagcctttaaatcttttattgagcatcagggcccggccttttattctgcggaagagtgtgagaccgtcgcgcttcaatttttatacaagctttatccgagagcggacgagttttttaaaatgaacccgctgaaaacggacggaaggggcaggttccgcttccatttttccgtatggcatcaggatattccgctgcggttcggcgctgcgagaatacttgtcagtcccgtaacggggcttgtggaagcttacatggcgcctgacattgacccggagcagctggagaagatcaatccggtgccggccgttactcccgaagaagcaaaggccgcttttttatccgatttccatctgcggctggagtggcagcgcgattttacgccgtccggcaatgaaggatataagcttgtgtacaggcctgtctatcctccgtacattgatgcgcaaaagcgaaaaaagaaaaggttttattagccagggatcatttgtaaatgaggataatctttaaagcctctccaatcgcctccccaatcaaaaccgagcgttttggcaatcgatacgacctcaagccaatcgggcgtgccgtttcggtttccgtcgtacgtcatatcccacatcaggcttccatcctttttttgcagggcgaagtcgatcgcaaggccgtaattgtggtaagattccccgccttttgcgtaggtgacgatatttcctttttttgaacgtccttgacggtacaattcgttttgttcctcaattgatctgaaaccctctgtaataacgacggtgatgccttttttcagagcggccgtctgcaatagctccgcattctgtttcacgagcggatgaagagcgcttggaatggctctatcttgtaatgccgtctgcggcctcagttctttctgcacataggaaaaacataggtctgcggaaaagaagaggatcaaaagcagcgcaattctgactggtagtttcatggtgaattctctctttctttaattgattaaaatctttgtttgctcactgccataaatttgctatgataaaatataacataattagtagccggaggaaggaggcaaatctatgaaatccaagattccatctgaagaagtggccgttaagatgaatgaatggtataagctgatccgcgcgtttgaagccgataaagctgaagcgctgaagcgggagattcaatatgaactcgaagatatggaagaaaatcaggatttattgttgtatttttcattgatggaatttaggcaccgcatcatgctggataaattaaaacccatgaaagacggcgactgccagcctccgttctctgaaatgctcactgagattgagatgaaccagcaaaagctgaccggcttactggaatattatttttactatttcagaggaatgtatgaatttaagcagaaaaacttcatctcagcgatttctcattataagcgggctgaggaaaagcttgaatatgtggaagatgacatagagaaagccgagtttctgtataaaatttctgaggtgtactatcatatcaagcagactttcttttcgatgaattacgcgggacaggcgcttgatatttacaagaaatatgaattatacggaatgagaagggtgcagtgcaaatttatcattgccggaaatctgatggacgcccagcagcataaaaaagcattggaatacctcgaatgcgccttggagcacgcggagcggctcgatgatcaatatatgattgctgcggcctattataatatcgggcactgtatgtacagtctgggtgacttttgcaaggcggcggaggattttgaacgggcggctgccggatttgaagcacacagcttccggcaggtcatccaggctgttttttcactcacacatatctactttaaaacggaaaaatacagtgaagccgccgccagctgcgcgcggggcatgagaagcgcggcggagtgggaagatgagatctatatgacgaaattccgtctgattaaagagctttatcagggggaaggcggacaggattcgctcaaagagtattttgacatcctggaatcaaaggagctgttggctgacacagaggaactgcttcaggacgcggctcatttctttcataaacgggagaactacaaagcggcatcttattttttcagcaggcttgtcggcgtgcaaaaaaggctgcaaatgaacaactacgcataatgaaaaaaagaacgagggagcttcggtttcatcgttctttttatgattccttttgttttcagccgattaaaaccgggtacatgctctgtattaacatcagggaggaaatgagacaatgtatcaggatttacagggaaaaacagcgatcgtaacaggttcttcgaaaggaatcggaaaagccattgccgaacgcttcggcaaggagcggatgaatgtggtagtgaactacctcggtgattccgccggagcggaagaagcggcggacatcattgagaaagcgggaggcagagccgtcaccgtaaaagccgatgtatcctcagaagaagggattcaggcgctgtttaatgccgcgcaggagtatttcgggggcgtggatgtgatggtcaacaattccggctttaacggagccgaagcgatgccccatgaaatgagcctggaggattggcaaagggtcatcgacgtcaacgtgaccggcacctttttgggggcgaaagcggcactgaaacatatgctcgagcgcggcaaaaaaggaacggtcttaaacatatcgagcgttcatcagcaaataccgcgtcctgaaaacgtgcagtactcggcatccaaaggcgggatcaaaatgatgacggaaacgatggcgctcaattacgcagacaaaggcatccgggtgaatgccatcgctcccggaacgatcgccacagagtccaataaggatctggaagatgaaacacataaacaggcccagctgaaaaaaattccgatgaacgccttcggaaaaccggaagaagtcgccgcggccgccgcatggatggtgtcggaagaagcgagttacgtaaccggaacgacacttttcgtcgacggaggcatgacgctttatccgtctcagctggaaagttaaaaagaggaggggaaaccttctcttttttgtttagagaagggtcataaaggaaatggttctctaaaaaacaggagggccgcaagatggcgagtgactggtggaaagacgccgttgtctatcaaatctatccgcgaagcttccaagatacgaacggcgacggcataggcgacctgcgggggattatcgcgcgtctcgattatataaaagaacttggcgctgatgtgatatggatctgcccgatttatccgtcgccaaacgtcgataacggctacgatgtgacggatcatcaagcgattatggaatcatacggaacgatggaggactttcacgatctgcttacagaatgccgcaaccgcggattaaagcttgtgatggacttcgtcttaaatcatacctccacggagcatccttggttcaaagaggcggaaatgaatccggacagcaaataccgcgattattatatttggcggccgggcaccgcggacggcccgccgaccgattgggtgtcggattacggacaatccgtctggcagtacgaagaacatacgggcgaatattacctgcatatgaacgccgtcaaacaagccgatctgaattgggaaaatcccgaggttcggcaatcagtatacgagatgatgagattttggctcgataaaggcgtggacggattgcgaatagaccagcttcatcttctgtcaaaaaaagaatacttgccgccgtatgaagattatatcgctcgccgggccgatccaaagcctttccggccaaacggagcacggatacatgattacttaaaagaaatgacgaaagaggtattttccaaatatgacgtgatgtcggtcggcgaggcgggatcagtgacgcctgaggaggggctcgtttatacgggaaccgatgagcatgagctgaatatgatttttcattttcagcatatggagcttgatcaaaagccgggccaagagcattgggatgtaaaaccgcttgagctggccgatttgaagaaagtgctcacagactggcaggaaaaactggaacatcaaggctggaatacgctgtattggtgcaatcatgaccagccccggatcgtatcccgtttcggagacgaaggcacataccgcaaagcatccgccaaaatgcttgccgccctgctttatttcatgaaaggcacgccgtacatttaccagggggaagaaatcggcatgacaaacgctccgtttgacagaatagaggattatcaagatattcagaccgtcaatatgtatcataaaagggtatttgaaatgggccgtgacagagaagaagtcatggcgtccattatggcgaaaagccgcgatcatgcccgtacaccgatgcagtgggacggcagcaagaatgccggatttacggagggcgaaccgtggctgaaggtcaatcccaattacaaaaccgtcaatgcggccgaggctcaggatgatcccgattctatattgaacttttacaaaaaactgatccgcctgcgaaaacagtatgctgatatcataaaaggcagctacacgctgctgtttcccgatgacccgcagctgtttgtgtatgaaagacaggcaaacgggcaaaaactcatgtccatcagcaacgtatcgaaagaagaagccgccttttattggccggacggctccgaacctgaaagggccgagctgcttctcagcaactatggaaataacggcggcgcggaatcccgcatcacattccgcccttatgaaacaagagtctatctgcttgcctgatatgtgatacgacgcccccgtccatacatggcgggggctttttaggtaaatcggatatcaatttagaaaaaatatcttgcaaaacgtaattacttcgttttattatggtataggtaacaaatgaacgagaaagtacgctttggaaatcgtcatcattctgatttacagaacagggggaaacagcttgtttaaaaaatggagcggaatcattgtcattgcggcatgctttttaatcgcggcgggctgcggcaattcatcttcgaaaggttcgtcaggttcttcgaaaagcggcaaactgcacgtcgtgacgaccttttatcctatgtacgaattcacgaaacaaattgtcaaagacaaaggcgatgtagacattctcatcccgtcttcggtcgaaccccatgattgggagccgacgccgaaggatatcgccggcattcaaaacgccgatcttttcgtatacaacagcgaatatatggagacatgggttccttcagcggaaaaaagcatgagctctgatcatgcgaagtttgtaaaggcgtcaaaaggaattgacttgctcgaaggttcggatgaagaggaagaggaacatggacacggcggtcatgaccacagccacagcatggaccctcacgtgtggctcagcccggttcttgcgcaaaaagaggtcaaaaccattacggcgcagatcgtaaaacaggacccgaagaataaagcatactatgagaaaaatagtaaagaatatattgcaaaactgcaggatcttgataaactataccgtacaacattaaataaagcgtcgaaaaaagaattgatcacacagcacgcggcattcagctatctcgccaaagaatacggcttaaaacaagtcgcgattgcaggcctttctcctgaagaagagccgagtgcggccaaactggcggatctcaaaacgtttgccaaaaagcatgatgtgaagatcatctactttgaagaagttgcatcgcctaaagttgcagatacacttgccggtgaaatcggcgcgaaaacggaagtgctcaatacactggaaggtttaagccaaaaagaacgggataaaggcatcggttatatcgacattatggagaaaaaccttgatgcactgaaagattcgctattggttaaataacatagtgtgcgccgcggggtgcacactatttctatgcgggaaaggaaggtcagcatgaatctcgttacattacaggatatcgtttttggttattcgcatacacccgtgcttgacggtgtgtcgctggaaatcaaaagcggcgaattcgttggcattacaggaccgaacggcgcgtcaaaatcgacgctcatgaaagtcatgctcggcatgctcagaccttgggaaggaacggccgagatcagtaaaaaaaacgcagccggaaaacgcctgacaatcggctatgttccgcagcagatttcttcatttaacgcaggattcccaagcacagttctggagcttgtgcaatcaggccgttatacgaaaggaaaatggtttaaacgattgaacgaaacggatcaccacgaggtggaaaacgcgctgaagatggtggaaatgtgggatttccgccaccggaaaatcggcgatttatccggcggacagaagcagaaaatctgcattgcgagaatgcttgcaagcaatccggatctgctgatgcttgatgaaccgacaaccgcggttgattatgagagcagacagggtttctacgaatttatgcatcatcaggtgaaaaatcacaaccgcaccgtcgtcatggtgacacacgaacaaaatgaagtacagcagtatttggataaagtcatacggcttgagaggggggaaaaaggcggatggaaatgtttgacttggaattcatgcgacgagcttttctagcgggaagcatgatcggaattatggcgccgatattaggcgtatatctcgtgctgagaagacaggcgctgatggcggatacgctgtctcatatttcattgtcgggcgtggccatcggtttttttctcagtaccaatattacggcggcgagcatcgttgtcgtcacgatcggagcgatcggcatcgaatatatgcggcgggcataccgtacatattcagaagtatccatcgcaatcttaatggcggccgggctgtcgtttgcgatgtttctgatcagcctgtcaaaaggcggcgcgtcgatgagcatcgatcaatatttatttggatcgcttgtcacggtcagccagcagcaggtctatattatcggaggcattaccctgctgattctgctttatttcattatattaaacagaccgctctatctgcttacctttgacgaggcgacggcaaagacatcaggcattaacacaaacctcctgtcaatgtcattcagcatcgtgacggggctggcgatttcggtcattattccgattatcggcgtactgctggtttccgcgctcctcgtactgcccgcggcttttgcaatccgtatcgccaaagggtttaaatgggtgtttgcggcggccattattatttctcttttcagtgtgttcatggggctgacgtcttcgtaccagctcggaacgcctccggggccgtcaatcactttactgttaatcattctgcttctgctcggctttatgctgcaggggatttggaatgcgtttaaaaaaggaaaagaacgaaaaaaccgccgttaagcggtgcagcagtttcatctgctgctccgtttgacggcttttttttacagaaatatatcagcaagacgctcatatgactctttttttgcttcgaaatcaaagacgttgcacagcaccatcatctcttttgtctgataacgttcggaaagttcaagcagacggcgtttcactgcggcaggtgagccgatcaccatccgcttcctgttttctgcaatctgtttacggtcctccggcgaatacggataagccttcgcttcttccacactcggcacgcggctgtcggcgccttttccgacacgaagaagccataaatcctggcttaaggcgagttcttccgctttctcatccgtagctgcgcatatgacgaaaatggcacagagcgaggcgggagcggaaaaatgggcggaagcccggaaatggtcccgatagatctgaaaggctttttccccgcgttccggattaatgaaatggccgaagacatagcccgcaccttgaagagcggcgcgtctggcgctgttttccccgaggccgagcacccaaagctgcggggctgtttcaatcaaaggcgctgtttttattccggcataagcatggtccgagggaaccgaatctgtcagaaaggatgataaatcctgaagctgcctgttaaactcggtcatgcttttctttaccccgtctgtgagggcgagccggattttcgtcgtgcctcccggtgagcgtccgaccccaaggtcaatccggttcggatgcagcgcctcaagctgacggaaagtttccgcgactttataggggctgtactgcggcagcagcacgccgcctgatccgactcggatggatgttgtggctgcggcggtatgagcgatcataatttccggcgaaacgcttgcgagccctcttgtgccgtgatgctcggcaaaccagtaccgcttatagccccaaccttcgctgaggcgggcgagctccgctgaacggcggagcgtctcgtgcggcccgtttcctttggatacgggcgcctgatcaagtatgcttaaatcaatcactcgtctgcccctttcctgacatgtattgatacaaggataggaaaaatgttcagtccccgtcaatttctttgttttctctattctctccggaacgaaggagaatataggaagtaatttttcgccgtttttcgccaaaaattcttatgttttatgaaactttgatataataaaagacgtatatcttaataaacaccgggattcttgtcccggaatttagtaaaaatgcgcacttgcggcgtgcttagcggcacccttacagaataggagtgaatcatatggcgatctctttacaaaaaggacagcggattgatttaacaaaaggaaaagccggcctgtcaaaactgctggtcggactcggctgggaccctgtatcatccggcggctttttcggaaagctgttcggcggaggcggtgccaatatcgactgtgacgcttccgtactgatgcttgaaaatgataaaatgacagacagcaaaaacgtcatctatttcggcaatctgaaaagccggtgcggcggtgtcgtacatacgggtgacaacctgacgggtgaaggcgacggcgatgatgaacaaattctcatcgatttggcgaaagtgcccgctcagattaataaacttgtgtttgtcgtcaatatttacgactgcgtcagacgaaaacaggacttcggcatgattcaaaacgcgttcatccgcgtcgttgatcaggctaatcgcgaagaactggtgacttacaatttaagagataactattcaggcagaacgagcctgatcgcggctgaaatctaccgcgaggacggcgagtggaaattcgccgcggtgggagaaggcacaaacgatacaaaaatcggcgatatcgttaaccgatacgcctaaacgataaaaaggagagtgcacacatggcaatttcattggcaaaaggacaaaaagtagatttgactaaaacaaatccgggtctttctaaagtcgttgtcggccttggctgggatacaaacaaatacgatggcggacatgattttgatttagattccagcgtctttctattaaatgaagcaggaagatgcgcgtcgcccgatgattttattttctataatcagcttgaaggcggaaacggctctgtcgcacattcaggcgacaacctgacaggccagggcgagggcgatgacgaaagtgtaagggtcaacctgagcgcggtgcctgccgctattgataaaatttcattcgtcatcacgattcatgaagcggaagcgcgcggccaaaacttcggacaagtttccaacgcgttcgtgcgcattgtcaatgaagagacaaatgaagagctgatccgctacgatctggctgaagatttctcaattgaaacagccattatcgcaggagagctttacagacataacggcgaatggaaattttccgcgatcggctcaggctatcaaggcggactggcccgtattgcgacagattacggcctgcaaatcggctaaaaccatatcaagcacagaagggagagacggcacatggctattcaattggcgaaaggacagcgtgttgatctgacaaaaacgaaccccggtcttacaaaagcggtgatcggcttaggctgggatacgaacaagtactccggagggcatgactttgaccttgacgcgtcggcttttcttgtcgatgcccatgacaactgtgttaatgatcttgattttgttttctacaataacctggaacacccgagcgggggcgtcatccatacgggagacaaccggacgggcgagggagagggagacgatgaacaaattatcgtcgacttctcaaaaatacccgcaaatattgaaaagatcggcatcaccgtcacgattcatgatgcggaagcgcgcggccaaaatttcggacaagtttcgaacgcgttcgtgcgcgtcgtcgatgaaaacagccagaatgaactgcttcgtttcgatttaggggaagacttctcgattgaaacggcggttgtcgtttgtgagctttaccgccatggggctgagtggaagtttaacgccatcggcagcgggttttccggcggtctggcatcactttgccggaattacggcttgcaggtgtaagcaggaaattaccgttttactaaataggaggaaaaaacttggattttctacatcatattatgtcgacctacgcttccttttttgattggaaaatgtggggtgaggtgctgactgaccctgtatcatgggggctgatcggttccttggttctgctggaagggctgctgtcggccgacaatgcgttagtgcttgcggttatggtaaggcatctgcctgaaaaacaacggaagaaagcattaacatacggattgttcggggcatatattttccgttttatctttatcggaatcgggatgctgctcattaagttctggtggatcaaagtgcttggcgcgctgtacctggcttggctcgtcattaagcatttctggatcggagaaggtgatgacgatacggaaggcatgaagaaaaattcatggatggtccgtacgttcggaattttctgggccactgtcgtttcagttgagttaatggatctggccttctctgttgacagcattttagccgcgtttgcggtatcggaaaaagtgtgggtgctcttgatcggcggtatgctaggcattctcatgatgcgtacagtcgcaaaagtattccttgtgttaattgataaaatccctgaacttgaaaacacggcttttgtgctgatcgggattatcgccgtgaaaatggcggcgagcgcctttgattatgaaatgccgcacgtggtgttcttcggaatcatcatcgctgcgtttgtggtgacgtttattatccactatttcaacaaacaaaagcaggttcaggagcagacggctgcatctaaagaagaataaaacaaaaaaggagggagagttcatttccttccttttttgtaccgattattatgaagagaaaggaggaaaatgatgaagcaggaagaattggtgatccgaaaggccgagccggaaaatgatgactgggaaacgtttctgatgctgccgctgccggaacgtcccggttacgagcgggaaaacgggctggcgtttacccggcttgccgtccggattttgggcactccttatgatgagacggagtattacagtaagcttttcgagctgtcttctcatgaaaacatccatgtgttgagcgagacgctggataagaccatcgcgccggaaacgtttcaggcgctgcagcacatccattcggtcaatcaaaaagagaaagggctttcggtttccaggtttgtcgcgtttctcgatgggggcaggctgcttgccaaacacgctgatccgcttatgcaccgccggctgaggaccgcgtttatgacgcttttggaaacctttgcggaccggcatgaaaacgggctgaatcatcccgatttccggcgtgtgctcttggatgtgtcaaagttttcgctgaaccacctgaatccatggctcgaacaagccgatatagagcgtgagatgccgaaggtggtgtggtatggagacgctaccaaaagccagctctattttctctattatctcatgctgatcggctgtgatgtcctattgtttcatccggctgcggaagacccgttcagcttgattgatccggatgaggagctcagctttgtgataaagctccccgcaacaggcggtcttgagccttttccgaaagaaaagccggacagaacgtccacgacggcctaccggtcaacgaaagaaattgagcatgtgctgaaccatgaggaatccatgatgtataagccttggcagttcagggagcacaccccgcagtccgtgaccttaaaaacgacatatgatgagttatttctcattgcgaaggagcgggcgtttatccggccgcaatttaaagcggacagggagcgggtggccgttccgaacctttttgcgaaagtgatgggggtttccaaagatacgaaagaatattggaacagacttcataccgccgcggactatcaggagacacacatgatccgcagttttccgtttacggaagagctgaaagccaactaccagtatcactacagtcaggttttaaatgaaaaaggagagattgacgcggacaggctgaaaagaagcaacatctggcagtacaagcatctgccttcaggtgtgcagagcgccatcgccaatgtgatttctgacatgtgcagaaacccagggctgaagactttgcccggggagcagtcaagggatgccgcaatctatttgttccgccaggcgacgaatctgcccgcttcgctgctgcaattgattcagacgtttgattacgcccaaaccgttccgaaactcgttttatatcatacggaacaaaatggcgaactcacacgttctgatgccgccgctcttttgtttttaaataaattcggcgtcgatatcatcttgtataatccgccgggccatcaggacattgagcattatattgaagaaagccaatttgatgtccattggctggaggacatggtgtttcggcaggaatataaggagccgtcactcgtaagaaagctgtttagaaccattacgcaaaagcagggagagtaaataaacatgacagaaaatcaaaatccgcttgttcttgataaaaatgaagagatttctgaacaaaaagcagatgacatccggatgcagctgcgccaagaccctgaagtgcagcgcatttcgcagcagattgacgtgaaaaaccaaatggagctgcttgagtacggaaaagaaccggcagttgaaatctcgaagttctccgaccgcatcttaaatatgatgaaaacaacaagtgtcacggattcaggcacaatgctgacgcagctcggaaaaatcatggaccgtttcgacaaaaatgatttcgatgaaccaaaaggatttctcgctaaaatgttcaaacgcggcaacagcatgattgaaaagatttttcaaaagtaccgcaccctgggcggagaaattgaaaaaatccacgtcgaaatttcgaaatacaaagatgaaatggcaaagacgaaccatacgcttgaagagatgtatgaaaacaacattaactactacatggagcttgaaaaatatgtcgttgccgggcagatgaagcttgaggaaatgcaggcgctcattccttcttatgaagaaaaagcggccggcgggaaccagcttgcgcaaatgcagcttgacacgctgcgtgacgggcttcaggcgcttgaggaacgtgtctatgatttagatatggcgcggatggtggcgctgcagacagcgccgcagatccgcctccttcagcgcggaaatacgaagctcatcgggaaaatcaattccgcattcgtcattacaattccgattttcaaaaacggcattattcaggctgtcacagtcaaacggcaaaagcttgtggctgattcaatgagcgagctggaccgccgcacgaatgaaatgctgaagcgcaacgctgaaaatatttcaaaccaaagcgtggagatcgcccgtatggcaggccgtccgagcattgacattgagacgattgaaacgtcttggaatacgattgtcagcggtatgcaggaaacgaaacagatcgaggaagagaacagacgtatcagagaagacggagcgaaacggattcaacagcttcaggataatattaaaaacgcagtcttaaagaattaacgcacaccccgcttgcttacggcaagcgggatttttttgtgaaaaaggtaatgacaatgtgtaaagacatgtgtaaacttatacggtaatcattttcgatttgaggtgctgcttatgaacaaacaacctgccgtcactccgcgaaaacttctggcgattgccggaatgggctggctgtttgatgcgatggatgtcggaattttatcgtttattatcgccgcgctacacactgattggaatttaacacccgatcaaatgaaatggatcggaagcgtcaattccataggtatggcagcgggtgcgtttgtattcggaatgctggccgacaggatcggccggaaaaaagtgtttatgatcacgctgttattcttttctgtcggaagcggcatatccgctttcgcaacgggattgacggtttttctcatattgcgttttctgatcggaatggggcttggcggggaactgcctgttgcctcgacgctcgtgtcagaagcgtccgctcccgaaaagcggggacggatcatcgtgctgcttgagagcttttgggccgcgggctggcttcttgcggcggtgatttcctactttgtcataccggcattcggttggcaggccgcactgctcttaacggcgctggccgcgttttatgcgctgtacttgcggaaaagccttccggaatcaccggcgcatcaggcattgccgcagaaaaaaagcatacgcgggcaggcgggaagtgtctggacgaaaccgtatatccgggcgacggtgctgctgtctgtcgtttggttctgcgtcgtcttttcttattacggcatgtttttatggctgccgagcgtgatgctgatgaaaggctacagcatgattgagagcttcgaatacgtccttctgatgacacttgcccagcttcccggatatttctcagcggcgtggctgatcgaaaaagcggggcggaagaccatcttagtcatctatttgctcggaacggcgggcagcgcttatttcttcggtgccgcggattcattgggcatgctgctcacagccggcatgctgctgtccttcttcaatctcggcgcatggggcgtgctttacgcctatacaccggagcagtatcctgcggcgatccgtgcgaccggttccggaacaacggcggccgtcggcagaatcggcggcattttcggtccgcttctcgccggatcgcttgcaggacggaacgtttcgtttacagtgattttcgccgtcttttgtgcggccatcctgattgccgtcatcactattcttattctcggaaaagaaacgaaacagacagagcttgcgcaatgagcacccttttggggtgctttttttagtggggctgtctgttggcagacctatatttttccttaaaattccttatttttaggaagcgaaaacttctttttccgggacaatgtcgcaaaaaagttcttgtatttgtaaaaaaaggataggaaatcagtttgcagcacattcgatggaaacgttctcaagcctgataaaagcccggtttccgttataatttatcctcaataaggaggattagagagtatttagaagcataccagaggaaaataagacacagggatgtttttaaagtaatgatacaaaataaaagggattatgatgtttgtttgacttattacaaacgtgttacggtattaaagattgcttattatggagggaaaatatgaatttggatgagaaaccaattaagataaaagtcgaaaatgtatctaaggttttcggaaaacagacaaaaaaagccattcagatgctgtccagcggaaaaaacaaaaaagagatcctgaaagcgaccggatcaaccgttggtgtcaatcaagcaaactttgatgtatatgatggggagatatttgtcatcatgggtctatcggggagcggtaaatcaactttagttcggctgttaaaccggcttattgaaccgactgccgggaatatttatattgatggtgacatgataacaaatatgtcaaaagaccagctccgggaagtgcgccggaaaaaaatcagcatggtctttcaaaaatttgcgctgtttccgcacagaacgattcttgaaaatacggaatacgggttggagctccaaggcgtcgacaaaaaagagcgtgagcaaaaagcgcttgattcgcttaaacttgtcggtcttgaaggctttgaacaccaattccctgatcagctcagcggaggaatgcagcagcgtgtcggacttgcccgcgcattgacgaatgatcctgacattcttctgatggatgaagctttcagtgcgcttgatccgctgatccgcaaagacatgcaggatgagcttttagaccttcatgactctgtcggcaagacgatcatcttcatcacgcatgatcttgatgaagcattgcgcatcggtgacagaatcgtgctgatgaaagacggtaacatcgttcagatcgggacgcctgaagaaattctgatgagcccgtccaatgaatacgttgaaaaattcgttgaggacgttgacttatccaaagttctgacagcgggccacatcatgaagcgcgctgaaaccgtgcggattgacaaagggcctcgtgtagcgctgcagctcatgaagaatctcggtatttcttctatttacgccgttgataaacagaaacagcttctcggcgtcattcacgcggcggatgcgaaaaaagcggtggaatccgacttatcgcttcaggatattttaaatactgaatttacgactgtgcatgaaagcacatacttgacggaaattttcgatgtcgtgtctgatgcgaatattccgatcgccgtcacggacgataaggaccgcatgagaggcattgtcgtaaaaggcgcattaatcggcgcgctttcaggaaataacgattatataaatgttgaagattctgctgaacaagctcaggattcttctgttcagggggtgaagtaaatggacagattgcctagaattccgttagcagatatcgttgaccggtttgttgactggcttaccatgacgttcggaggtttctttgacggaatctcaaacggtttggccgctttcgtaaacgcgattgtgagcggtttgggtttcatcccgtctattttattgactgttatttttgcagctctcgcttggtggatcagtacgaaaggaattgcactctttacgttaatcggattccttgttattgattatttgggttattggtcgccgatgctgcaaacgttggcgcttgtcgtcacatctgttttgatttccattattatcggggttccgatcggcatatgggcgtctcagaaagaaacggtccgccgcattgtcacaccgattctggatttaatgcagaccatgccggctttcgtatacctgctgcctgcaattttcttctttaatatcggggttgtgccaggcgttgtggcatctgttattttcgcgatgcctccgacgatccgcatgacggttctcggtattaaacaggttccggctgatctgattgaagcgacggaagcattcggttcaacgacgtctcagcgtctgttcaaggtgcagcttccgcttgccacaaaaacaattcttgccggtattaaccaaagcatcatgcttgctttgtcaatggtcgttatcgcggccatggtcggtgcgccgggtctcggttctgaagtatacagcgccgtgacacagttgaaaaccggtgtcggagtggaagcgggtatcgcgatcgttatcgtagcgattacactcgaccgtatcacgcaaaacattaaagtgaagaagaagagcagggggaatgcctgatgcttaagaaaatcatcggtgtcggcgttaccgctgcgctggctctttctttggctgcctgcggttcgcagactgatggtaaggcaacggctgcggatcaggtgaacaaaaccattatcggtattgatccgggatcggggatcatggccctgacggatgaggccgtgaaggattacggattgaaagactggaatgtcgtcacggcgtcaagtgctgccatgacggcgacattgaagaaatcatatgaccggaaaaagccgatcatcgtaacggggtggacgccgcactggatgttctccagatacaagctgaagttccttgatgatccgaaaaaaacgtacggaactgccgagcagattcatacgattacaagaaccggcttcagtaaggaacagcctaacgcggccaaagttctcagccagttcaaatggacgcaggacgatatgggagaagtcatgattgccgttgaggaaggcgaaaagccggccaaagccgcagctgaatatgtgaaaaaacataaagaccaagtggctcaatggacaaaaggcgcccataaagtcaaaggggataaaatcaacctggcttatgtggcatgggacagtgaaatcgcaagtacgaatgtaatcggaaaagtatttcaagacctcggctatgacgtgaagctgacgcaagtggaggcaggaccgatgtggactgcgattgcgacaggcagcgcggatgcgtcattgtctgcttggcttccgaatacccataaggcatatgcgtctaaatataaaggtaaatatgaagatgtaggaacgagtctgacaggcgtcaagatgggtctggtcgttcctcagtacatgaaaaacgtcaattcaattgaagatctgaagaagtaatgaggaaaagcagccctgtaacgggctgcttttttttatgcttcaaacgatttgaggacggcggccgttaatatctcaacgccagtaaagatggcgcttcggtcaaatgtcatttggggatggtgaagtcccggctccaggccgcaccctaggccgagcatcgtcgttttcaagttcggcacctttaacccgtaaaagtgaaaatcctctcctccggttgtcacaaggggttcatccacatgttcttctccgagaatgctgctgatcgcagatgccatgatggcttccgcctccttgtttcgctcggctgccgggaggctgtgttctttttgcagttcgatttttgcgccgaatgcggcagccgccgcctcacaggctctttcggtttcggcggttaatttctccatggcggcattggtttgtgcgcggagatcaaggctgaacgatgcttttcccggaatgatattggaactttctccgcctgcctgaagctttgtcatcttcacggaatgcgggatgccgggatcaagatgaatgaagctgagtttttggacgagaagagcggcgatttcgatactgttaagcccgagatgcggtctcgcgccgtgggcttcttctccgataatcaggccttctatatgttggcttgagccatgcaggatggacggtgcgcatcggccgtttgccgtttcctgtacggggcgcacgtgcacgccgtataagaagtcaacatcatccagtacgcctttttcaatcattttcagcgctccgccgcctttttcttcagccggctgaaaaataaagcggatggtgcccttcggaagcttcggctgactctttaaaagcatcatcgtgccgagcgccatcgtcatatgtgaatcatgtccgcatgaatggttcgcctgaaagacaccgtccacttcctgccacagcgcgtcaatatccgcccggacagccacaacgggcgagccttctccgatttcgccgacaacaccggtgcaatcatcaaacgtacggattcggcagccggcctctttcagttttttagtcagatattcagttgtttgatattctttccagcttacttcgggattggcgtgcaggtggtcaaaaatgtccataatgacttgcttttcatgctctgtgagtctgttcatgccgtaagtcctccttcaaaagctgtctgttttttattttttgatattgaaaacaggcaatcggtctgtatataatatagcacatatctgtattttctgaatagtttataaatttaaagcgggatggtgatgttatggctgtgccgaaggccgaacctgtattgaaaaagaagaaattgtttgtgatgcctgatgcttatgtgctgctgttcattgtcgctttactatgcgcgatagcatcgtacatcgttcccgcaggggaatttgacagggtgacaaagggcagtgtgacgtccgccgtcccgggaagttatcattctttagaacagtctcctgtcagcccgatcgctttttttaccgcgattcaggaagggatgacaagttccgcgccgattatttttttaatcctgtttacgggcggcaccattgcgattttggagaaaacgggcgccatcaatggattgatcagtaatgtcatcagtacgttccgcgcaaaacagctgctgtttattgcgattgtcggatctctattttcgatcctcggcacaaccggcatcgtcgttaattccgtgatcggttttattccgatcggcctgatcgtcgcccgttcgctgaaatgggacgccgtggccggagcggccgtcatttatatcggctgctatgccgggtttaacgcgacgattttatcaccttcaccgctcggtttatcacaaagcatcgcggagctgccgctgttttccggcatcggcctgcggattgccgtctacatttgttttctgctatcatctattttatatatttatcggtatacgagaaggctcagaaaagcaaaggacgccagtctgctgggaaacgattggtttccggcggcaggttcaatcccgcaggcttccgatccggaggacaagccagtcccgtttaccgtccgccataaattgattctggctgtcgcggctttgtcgcttgccggctttttatacggcgcgcttactcttggctggtctgattcagagatggccgccgtgttcatttttatctcaatcgtgtcaggcctgattgcgggaatggcggcaaatgatatcgcaaaaacgtttattacaggctgtcagggcctcgtttacggcgcgctgatcgtcggaatggcgagaagcatttccgttattctggaacacggaaagctgcttgatacggtagtcaatgggcttgcgtcactgctgcacggtttcagcccgatggcaggcgcaatcggaatgtatatttccagcgccctgcttcattttctgatatcatcgggctcaggggaggcggtcgtatttattccgatcttggcgccgcttgccgatctgatgggcatcacgagacaggtcgcggttgaagcggtcatgctcggggaaggcgtcgtaaactgtgtcaatccgacttccggcgtgctgatggccgtactggctgccagcggcattccgtacgtaaagtggcttcgcttcatgattccgctggcgctgatttggtttgtcatcggccttgtgtttatctgcataggcgtcctgatcaattggggtccttattaaacattttgtcaatgatatttcggtttatcattatgaatcggcaagatataatgggagttgtaagccattcttaatagtacgggaggaagtcatgaatcagcgtcggaacggactttcaaacgtgaatggaaagagtgagagtgtgaaagagaaagaacgaatgatttggtcagaagtcggaatgcttgtgggcacactgtctttgcttgacatcatcgtacgcggacttgttctgaactgtccatttagggaatgggccggaagcttggcggttttcttcattataattgtttattattgcatcagggcgggagcgtcgggaatgctcatgccgagaatagacaccaaagaagaactgaaaaagcgggtgaagcagcagcggatagattcaattgcggtcacttttgcggtggcggcgcttacgatgtacgacagggggtttccccatacattctttgcttggctgaaaatgatctttctttttatcgtctgcggaggcgttctgtttttgcttcggtatgtcattgtgaagctgtcttacagaagagcgataaaagaaataaaaaagaaataaaaaagaaatcatcctgacaggtggtttcttttttttgtttgaaagcgggaagtctttttaattgataggaatatagatttgaattcactctgtcacgttgctttgatagagagagtgtgataagttgaaatgtaagcgttaacataattctccagtcttcacaacagttgaaaggagctgaagaaagagtaagaggaatttttgactccgcagtcagtcttcaaaaatgaaataaggagtgtcaaaaatgtttgaaaaacgattcaaaacctctttactgccgttattcgccggatttttattgctgtttcatttggttttgtcaggcccggcggctgcgaacgctgaaactgcaaacaaatcgaatgggatgaccgcgtcatcggttaaaaacgggaccatccttcatgcctggaattggtcgttcaatacgttaacacaaaatatgaaagatattcgtgatgcgggctatgcagccattcagacgtctccgattaaccaagtaaaggaagggaaccaaggagataaaagcatgaggaactggtactggctgtatcagccgacatcgtaccaaatcggcaaccgttacttaggcactgaacaagaatttaaggacatgtgtgcagccgcggaaaagtatggcgtaaaagtcattgtcgatgcggttatcaatcataccaccagcgattacgccgcgatttctgacgagattaagcgtattccaaactggacccatggaaacacacaaattaaaaattggtcggacaggtgggacgtcactcaaaattcattgcttgggctgtatgattggaatacacagaatactgaggtgcaggcctatctgaaacgtttcttggaaagagcattgaatgacggagcagacgggttccgctatgatgccgccaagcatatagagcttccggatgatgggaattacggcagccgattttggccgaatatcaccaatacatcggcggagttccaatacggagaaatcctgcaagacagcgcgtccagagatactgcttatgcgaattatatgaatgtgacggcttctaactatgggcattccatcagatccgctttaaagaaccgtaatctgagtgtgtcgaatatctccccttatgcatctgacgtgtctgcggacaagttagtcacatgggtggaatcacatgatacgtatgccaatgatgaggaagagtccacatggatgagtgatgacgatattcgtttaggctgggcagtgattggttcccgctcaggaagcacgcctcttttcttttccagacctgagggcggaggaaatggtgtaagatttcccggaaaaagtcaaataggagatcgcgggagcgccttatttaaagatcaggcgatcaccgcggtcaatcaatttcacaatgtaatggccgggcagcctgaggaactctcgaatccgaatgggaacaatcaaatatttatgaatcagcgcggctcaaaaggcgttgtgctggctaatgcaggatcgtcttctgtcaccgtcaatacttcaacgaaattgcctgacggcaggtatgataatagggccggcgccggttcatttcaagtggcgaacggcaaactgacaggtacgatcaatgccagatccgcggctgttctttattctgatgatattggaaatgcgcctcaggtctttcttgagaattaccaaacgggggcagtccattctttcaatgatcagctgacggtcaccctgcgtgcaaatgcgaaaacaacaaaagccgtttaccaaatcaataatgggcagcagacagcatttaaggatggagaccgattaacgatcgggaaaggagatccaatcggcacgacatacaacatcaagttaaccggaacgaacggcgagggtgcagagagaacccaagaatacacgtttgtcaaaaaagacccggcccaaaccaacatcattggctatcaaaatccggatcattggggccaggtaaatgcttatatttacaaacatgatggaggcagggccatagaattaaccggatcgtggccggggaaagcaatgactaagaatgcaaatggaatttacacgctgacgctgcctgcgaatgcggatacggccaatgccaaagtgatttttaacaatggcagcgcccaagtgcccggacagaaccagcccggctttgattatgtgcagaatggtttgtataacaactccggtttagacggttatcttccgcattaatggatagggccatcatcacatcagcgtgccggcaaaccctcgcttctgggaaaaggacagcgcatcttcaatcacgctgaaaagatgacaacatcctaaaacggttccgttttaggatgttgtcaacaatctggaaaccatcaccgatatttttttgtccaaaaatcaaacttttctcttgcaaaagtttgtgaagtgttgcacaatataaatgtgaaatacttcacaagttaaaaacagacaccacgaaacactggaggatgagcatacatgatgaacgaacgagtgaacaaagtagcattaatcggagcaggttttgttggaagcagttatgcatttgcgttaattaaccaagggatcacagatgagcttgtgatcattgatgtaaatagagaaaaagccatgggcgatgtcatggatttaaatcacggaaaggcatttgcgcctcatccggttaaaacgtcttacggcatatatgaggattgcaaggatgccgatatcgtgtgcatctgtgccggagccaatcaaaaaccgggcgaaacgagacttgagctggtcgaaaaaaatctcgccatttttaaaagcattgtcggtgaagtaatggcaagcggatttgacggcatcttcctcgttgccacaaacccggtcgacattctcacttatgcgacatggacattcagcgggcttccgaaagaacgcgtcatcggcagcggcacgacactggattctgcgcgattccgttatatgctgagtgaatacttcggcgccgctccgcaaaacgtacacgcccacattatcggcgagcacggcgataccgagcttcctgtatggagtcacgccaatatcggcggagtgccggtacagcaattgctggagaaaaatgcagcttacaaacaggacgagctggatcagatcgttgacgatgtgaaaaacgcggcctaccatattatcgagaaaaaaggcgcgacatattacggagtggcgatgagcctcgcccgcatcacaaaagcgattttgcgtaatgaaaacagcattttaaccgtcagcacatatctggacggccaatacggtgtaaacgacgtctttatcggcgttccggccgtcgtcaatcggaacggcatcgcaggtgtgacggaacttgagctgaatgaaacagaacaggctcaattcagccgcagcgcaaacgtgctgaaagatattctcgctccgcatttcgcagagtaaacaaaaaagcagtacatgacaaacgccatgtactgctttttttaattcgcttttttcgccatttcctgagaggtttttactctcgcttttcccataaacaaaatggtaacggccgcaatgacgatcggcgccagcgcaagcgtaaatacatatgtgatgctttgcgacatggcgtcaataatgcgatccagaatgtgcggcggaatatgggcgcgcgtgccggcctggaaaatgtcctgcggatttccgatgttctgcatcgcgccgcccgctcctttcatgccgctgaatgaatctgtgagcttgttggtaaacacattcgtctggatggttccgaaaatcgtcacaccgagcgtcataccgaatgatctcaaaaacgagtttgttgagttggcgcttccgcggtaacgcggctccagatcgttcatggacgcagccgggagcagtgagaagttgaagccgacgccgaatcctgagatcagcatgaataccgtcagcatcgtacgcgccgtatccggtgtcatattggaaagcagcagcattccgataaagaaagcgaccacggaaatcagcattaaattgcggaaccgcactttcgtctggaaaattccgccgatcatacttccgataacagaaccgatcatcatcggcgtcaaaataaagcccgcgcttgtcgcggtgcttccgtacacagcctgaacgaagatcgggataaacaccgctaaaatgacgaacgtggctccgtaaaggaacgccagaatctgtgccgtagcaaataaacggtttttaaacatccaaaatgagataatcggttcttccgcttttctttccacgataaaaaaggcgataaagaacacggcgaacacagcgaacagaccgatgatctgcacggagttccaatcatacgtttttccgccgagctcaagagcgaacatcagaccgacaatggaaaccaccagtgtgattgcgccggcccagtcgattttctgtttcttatgttcaagagattctttataataacgaagaatgaaaaacaatgatagaataccgatcggcacgttgatgtaaaacacccagtgccagctgatggagtcggtaatgagcgcgcctaaaagcggcccgagaacgctggaaaggccgaaaacggcaccgaacatgcccgacattttcccgcgtttttccggcggaaataaatcaaaaatgatcgtgaaggcgatcggcatcagcgcacctccgccgattccctgaatgacgcggtaaataatgagctgatccattgtttgagcgattccgcataatgcagatccgattaagaaaagaataagaccgaataaaaagaaacgcttgcgtccgtacatatcggacagttttccgtaaatcggcataccggccataacggctaccatgtatgatgccgtcacccacgcgaacttatcgaaacttccgaggtccgccacgatatttcccatcgcagtggcaacgattgtattatccatagccgacattaaaatgcccagcaaaagaccgatgacgacaaactttgtcgaggcgtccttcgcggctgtttgttccatgcttttttcctcccatacttacttttgatcattaaatttgctatgatcatattagatttgccgaaaattatcttgatcgtcaagataaattgattttatagggaggcctgtcagttgtcaacaagaaataccagaagcgagacggaggaaaccgccatacagttattccggaagatggccacaaggacgatcctttttcatcaggcggccgctcaatctctcggtctgtttccgaccgatttgaaatcagctgatatcttaaatgaagcaggcccgatgaccgcaggcgagctcgggaaaaaaaccggcctcagcacaggttcggtaacggcgctcattgaccggctcgaaaaagcgggatatgtcatgaggaaaaaagaccccgaagacaaacggcgggtgatcatcgtgccgctgacagccggaaaagcgaatgtgaagcaattgttcagctccttatcccagtccacgatcagcctttgccggcaatataaagaagaagaactgcggctgatattcgattttttaggaaaagtgacggacataatggaagacgagcttgagaaattaaaataaaatatcatagcacggcccattcatgaataacttgtacaagttgcatgaatgagggggaagccaatgaacatctttttaagctacatcgttctcgggctgtcattgtcagcacctgtcggaccggtcaatgcggcgcaaattgacaaaggcatcaaaaatggcttttggcatgcatggattttcggtctcggcgctatggccgcggacgggctgtatatgattctgatctatttcgggctgtctcaatttttgaccgctccttttgtaaaaacgtttttgtggctcttcggttttttcgtgctgacctacacgggagtcgaaacgttaaaaaatataagggaagccatgaatgtcagaagcggaaaaggaaaaccggctttttacaaaacattcggcgcggggttttttatttctctttccaatccgctgagcattttattctggctcggcatatacgggagcattctcgccaaaaccgctgaatccttcgatgcaaatcagcttttgatttacagctccggcattcttctcggcattttgatctgggatttctgcatggcggtcgccgcgagcactttcagaaatctccttcatgaaaaagcgctccgctggctgacgggagcggcgggtgtgtctttgatcgttttcgggttttatttcggatggcaggggattcaaatgctcatctcataaatagaagagtcacccatcgcctatctccgtcataacgtatcatgacgatactggaggtgggccgatggcaagcgggctgtacacaaaaagttgccttgaggaaaagttattggatctgccaaattggcagagaatcgcttttgagcttctatcagaaaaagtaggcgataaagcggatacgtttccgtgcattcccggacgtcagggatttttgacagatcagctccggatatcctttgcgggtgatccccgcgaagagggaaccccggaggaagtggggatgctgctgtcagagtacggaaagatctcaaggaataccggaagatacgcgtcgctgcttgtgatttttgatacgcctgaggatttagctgagcattattccgttgaggcgtatgaagagctgttctggtcttttttaaaccggctgagcggctgcgacccgaaagactggccggaagacatgccggaagaccctgaacattataaatgggagttctgctttgacggcgagccgtattttattctgtgcgcgacgcctgcgcatgaagcgagacaaagcagaagcttcccgttttttatgctggcgtttcagccgagatgggtttttgaaggattaaatgattcaaccgcgttcggacgaaacatgagccggctgatcagaaaacgcttagaggcgtatgatgaagcccctcttcatccccgattggggtggtacggaggaaaagacaatttagaatggaagcaatatttcctccgtgatgatgagacgcaagtgtcaaagtgtcccttttcttatttgaagagactgtttaaaccgatgaaataagctatgatccggcagggctgtgtccctgctttttttgtacgatccatgtcacgatcgcaatgacggcgagaaaacaaaggctgaccagaaaaccgggccggctcgatttctcaaacagcgtcccggagacggccgcgacaatcagcacaagggcgataacaatctgtacggttcccatctttgtcgtttcaagcagtttcttgcccgagaacaaaatgaacagccacgtatacagaagcatgaggcccgccgcggttgtcatgtgttcatatatatttttcggcagcaccaatgacaggatgatggagacgatgagtccggcaaacgtcaatccgagcgcgggccagcagatttttttgttttcctttaatctgaagcatttcggcgcatccccgtcatcggccattgtacaaagcaatgtcgtcacggcaaacagcgaggcgacgagcgtggaaaatcccgcaataataaaaattccgttaaaaatatcaagaatgatatctaaatgaaaacccttcagcgatgtaataaacgggctgtcctgttcggtgaatttgcccagcggcactaacagcagcgccaggccgagagaaatgacgtaaatcactgcaagtacggcaagcatcagtctgcctgattttgaggcttcctccggttttttcaagtgtacggtcatcagccccaagacttcaattcctccgaaggcgtaaaacgcataaatcaatcccgtccataaccccatcgctccgtgcgggaacaaatcctttgattcgttcggcacctgcacatccggtttatgagaaaatataccgcacagcgccaatatggcgatcacgataaacataaaaatcgccgccgtcttgacaacagcgagcacattttccgttttttgaaaaacggacagccccgtaaatataatcaaaagaccgagcaccgcataaatggaggcgaaaatccacagcggcacattcggaaaccaatgcttcgtaaacagcgagatcgctgtcagctggcttcccgtgatcagcatctcggacgaccagtacacccatccgttgctgaaaccggcccaagtgccgaaagcctttctcgcataggcgcaaaaagaccccttttcgggctgtttggccgaaagcttcgcgagctgctcaaagacaaaataggtgccaagcccggcaataagaaatgagatcagcgcggaatatccgcttttgacaatagcgatgctggacccgagaaaaaagcccgtcccgattgtgcagccgacaccgattaaggagagctgccaccaagcgagatttcctttaggctggtcctgtgatttactcatgaagttcaacccctttatcaaagcttagattgcggccgtcagaaggggaatatacatccaataaattgctttacatgaaacaaacggccggagttcataatagaagaaaaaaaggagcagtctgatgacacagcaatttatcgtaccgccgaaaaaagggcttggcctgaaggttcacaaagggcagatcataaaagtagtcgatgtggaaggacagcaggtggctgattttacggcgtatcatgccaaggacttttatgagcatcttgatcagggcgcgacgattgatgccaaccagtccattcatgtaaaaacgggtgatcatatttattcgaatttatacaagccgatgctgacgctgattgaggatacagtcggcaagcatgacctgctgcttcccgcctgccgtccggatatgaacaggcttttatacggaaagcataaagatgagctccaggatacgtgctatgacaatatgagcggggcgcttgaaccgttcggggtgccgcggccgcatatgcattacccatttgccatctttatgaacacggtgctcgatgagaaggggaacttatcagtcgaaacgcctctttctgacgcgggtgattatgtacggctccgtgcggaaatggatctcgtcgttgcattttcatcctgtccgatcgaaaaaggaaaatgcaacggcgacagcatcacggcgctgcgggtggaaatcagctgatcccggtgtatttgattcacttaaaaactgcacctgtgctatatttaacaaagagtcgtacatagtggcatgattcattttcagcatgaacgggaaatgaatcataaagaaacaatgcaggaggagtgattgggatgagcatccagaaacaaattatgaatgatctccatgtaaaaccctcgattgatccgaaacaagaaattgaggacagagtgaactttctgaaacaatatttgaaaaaaacaggtgccaaaggctttgtgctcggcatcagcggcgggcaggattccacgcttgcgggacgcctcgcccaattggcggctgaaagcatcagagaagaaggcggaaacgcggaatttatcgccgtccgtcttccgcacggcacacagcaggatgaggatgacgcccaattggcgctcaaattcattaaacctgataaatcatggacatttgatattaagtccgctgtcagcgcgttcgccgatcagtacaaaaaagacacgggcgatcagctgtctgactttaacaaaggaaatgtaaaagccagaatgaggatgatcgcgcaatatgccatcggcggacaagaggggctgcttgtcatcggaaccgaccatgcggctgaagcggtgaccggtttcttcacgaaatacggtgacggcggagctgatctgctgccgctgaccggattaacgaaacgccagggcagacgtttattagaagagctcggcgcgccggaacgcctgtatttgaaattaccgacggccgatctgcttgatgaaaaaccgcagcagacggatgagaccgaactcggcatcacatacaatgacattgatgattatttagaaggaaaggacgtttcttccgaagtgattgaggcgctggaaaaacgctacctcagtacggagcacaagcgccaggtgccggcatcgatgtttgatgattggtggaaatagaaataaaaaaacctcccttttgaaagggaggtttttgtttatcgtttttatttatctacactttcataaatccctacccaataccctttgctgctgtcataatatttgcttttgaaaatccattttgttccgtttaaaacgaatgaagcagcgaaattgccgtcagggctttgaacgagcttgatggcattaatgccaacatctgctttcgttgagattgggctattttccacggatgcggatgctgttggtgatgcggcaaaggcaggagcggcagacatcagtaaggcaagagacagcgcagaaccggttaacacttttttgaatttcatttcgaacactcccttttcaaatgaaatgtattgcagtgttaataattagatgattatccatataattccttctttatttctaaaatttttttcttaaattgaaaaaaacatcccttcggagggactttttatttattgatccatttgcatggatcagggacatgttttcaaaacgtttttttatttgatacggatatgattcagcttcaccatcaatctgtcggtgaatcttcgaaggctgcctctcgaatcaggctcaagaggcagatttgcttgggcagcgatcgtttctgcgacctgctgaatagacatttggtctgtatggagatgttctgtgaagaggctatcagacaggctgttgatgcagcggtcgatttgttttgcggcccaggagtttttttcttccgctctggtgcgcaggcgtttcagcaatgtttcctttgaagccagcagggtaaagtggtgaatggtccggccatcctgtctcagcctgctgataatgtcatggaagtattgatcgttcgtaatggtcatgggcacaatgatgatgccctgatatgtatctgacaaataggaaagcatgctgtaattgaattcccgccacagaggatagctttgaaaatcatcttcagcgatatccggcggtatcatcgaacgcatcgcaaaccccatcttttcaggatcatatacgtaagacggtttcagtcttctgtgcagttcaaacgctgtttgtgtttttccggaaccgaaagccccatttatccaaatgatcatcatgatatccccctttttctatatgatacaaaaaaaagacccttcgatcgaagagtcagcgggaaaaaacagacgtatattcccggagcgattcctttatatgcgtaaaggcatgttctccaaaatactcaagagaaacaaaaccttcatattgtctgttcatcagctcttttaaaaatgctttttgatcgagatctccttgaaaaatcggagttggcttgctgagataccagttgtcaaaattccagtgatagtttttcagatgaatatggcttacggtatgatacagcttttctaaagcggacatttggtcaacgtgattgacgtgtaggttggagccgtcaaaaatggtgcggacccgcggatgtccgacatcctccaaaaatgccagcgccgcctccggtgtatccgcgtacgtatcgtaatgaatctcaagcccgatatcgacttcatagtcatctgcgagccgtgccgcctgctgaaattgatcaaccgcacgttgccacttttccggtgacgtccgatgcgaaggaagattgccggcaaagactctgatcaagggactgtgcagctgtcgtgccgcgcttaatgccctttgaacatcctttaacgtctgcctttcatcctgagcggcgaagtcagtgtacaaactgacagcaggcaccccgaggctttcctcctgaagctgctgatcaagtctgtcgagcgggccgatttcctctatatattgtttagcgtgtccgtaccacagttcgattccgtcaaaggagtgctccttcgcgaaagaaatgatgtcgaaaatatgcttttttttaaatcctgtcgtgcaaaaactcagtttcatcggtaatcctcccgtaactgtctatcatatgtgtacttttccccgggtgagatacggataaacaggtgaaaagggcagacacttttataagcagggtgtcagtgcggcacacaaattgtttagcgcttttttgcgtcaaagtattaaataattgaccgaagtgttgtacaattaatttcattcgagtaagggggagaagccattgaaaaatgaaacggagctgacggacttcagtcccgtccgcaataaaccgactcgcgctcgttatgtgatactgtttcttttgttttttatcactgcgattaattatatagaccgtgccagtgtatccatcgccgccccgtccattcagacatcgctgaacataagccccgcgcttttgggcgtcgtcttttccgcattcagctggacctatacgggtatgcagattcccggcgggctcattttggacaaattcggatcaaaacggacgtacggcgtttctttaatgatctggtctgttttcaccggagtgcaggcttttgcggccagtttcgggtttttattcggctgccgcctgattatcgggctggctgaatcgcctgcgtttccggcaaacaaccggattgtcacgacatggtttccaaggcgggaacgcgcctttgcgacgggtgtttatacggcgggggaatatgtggggctggcgttcgccacaccggttttattctgggtgttaacggcatttgactggcgcgccgtctttatttcttcaggcgtgctcgggcttgttttctccgttttctggttcaaaatgtatcacgagccgaatcggtaccggaaagtgaaccgggaagagcttgattatattagagaaggcggcggactgacagaggtgtctgaatcagccggcaggatcacgtggcgggatttcgtccagcttcttaaataccgcaagcttgtcggcttgtatatcggccaattcgccgtagcctccacgctgttcttctttttgacatggtttccgacttatctggcggaggcaaagcacatggcattcttgaaagtcggcttcgccgcatcaatcccgtatatcgccgcctttttcggcgtattgttcggcggatattggtctgacggaatgatgaaacggggcgtgtcggtgaacgttgcccgaaaaacccccgtcatcctcggtcttctgctgacaggctccatcgtgctcgcgaatgttacggattctgctcctgcggttttgacgatcttatccattgcttcttttgcgcagggcatgtccaatatatcctggacgatgctgagtgaggtggcgccaagcgaaacaatcggattggcaggaggcgtgtttaactttttcgccaatatggccggcattatcaccccgcttatcatcgggtttatcgtttctgcgaccggttcatataacggagcgattctgtttgtcggcgctgtcgcatttatcggggcattttcttatattttcattgtcggaaaggtggaacgcattacgctccgatagaaagaaaaactcatctcttcttataaaggatgggttttctttcattgcattatctctatatttcaatattgagttatcatataataaacataactttttcatttcttaggaggatttcgccgaagatgaacgcaaaacgtgccattcccgtaagagaaagaaatatcgtactgatcggattcatgggggtcggaaagacaacaatcggccagctggtcgctaagaaattatacagagacttcattgatattgatttgcagattgagaaagatttcaatatgtccatccctgaaatgtttgagaaaaaaggtgaagcctttttccgtcagaccgaaaaggattatatattagatatctgccgcaatacgaaattcaagatcgtgtcacttgggggcggttcgtttaaacaagaggaaatcagacagtgctgccttgaaaactgtctcgtgctccatcttgatttatcatgggagaattggaagcagcgggctgacctgctgattgaaagccgtcccgttctgcataaccgttccatggatgaaatgcagcagctctttaacgagcgccaaagcatctatgataaacataattcaaaagtggcgacggataatctggaaccagaagaaatcgccgattatatcgtagaaacgttaaaaatcggctgggatctgtatcagccgatgtaaaaagagccgtgacgctgtgagcgtacggcttttttgttttcttttaaacaaacgtttattaaaatttttagaaaatgagtgtaaaatcgtgttaagatagagtcagaaaattaaatcttataaaacaaaggagattaatcggatatgcaattatacgacttgccgctcgaccaactgcaaacctataaaccaaataaaaccgctcctcatgacttttcggatttttgggcatcatcattacatgagcttgcaaaggaagaggcaaagcctgaattgacggctgaaagctacccggctgacggtgtgaaagtattccggctgacataccggagcttcggcaaggcggaaattgagggatggtacgccgttcccgaccggcaaggaccgcatccggccatcgtgaaatatcacggctacaacgcgagctatgacggggatacacatgacatcgtaaattgggcgcttcacggatatgccgcgttcggcatgcttgtccgcggtcagcacagcagcacagatacaagcgtctcaccgcacggacacgttcccggctggatgacgaaagggattttagataaagatacatattattaccgcggcgtgtacttagacgccgtccgggctttggaagtcatcagcggctttgatgaagtggatgaaacgagaatcgccgtcatcggcgggagccagggaggcggactttcaatcgccgcggcggcactatctgacattccgagagcggttgcggccgattatccttatttaagcaattttgagcgggccattgatgtcgctcttgatgagccgtatcttgagattaactcctttttcagaaagaacggcagccctgagacggagaaggccgcgatgaatacactggcctattttgatatcatgaatctggcggaccgcgtaaaagttccggtgctcatgtccatcgggctgattgaccgcgtgactccgccgtcgacggtgtttgccgcttacaatcatctggaaacggaaaaagaattgaaggtgtaccgatatttcggacatgaatacataccttctttccatacggaaaagctggcctttctgaaagcgcatctgaaaggctgacaacagcgaaaagcccaagtacttgggcttttttcaggaatgatcacggaaaaggacggatacagatggaacaaaggatcatcgaagaattaaaacgaattgaagcacagcacggcgtcaaggtgctttacgccgtagaatcagggagccgcgcatggggatttccgtcaagcgacagcgactacgatgtgcggtttctctatgtgccgaaaaaagaatggtacttttcgatcgaaccgcatagggatgtcatagaagagccgattcatgacatgcttgacatcagcggctgggaactgagaaaagcgctgcggctttttaaaaaatcaaatccgcctcttttggaatggctctcttctgagatgatctattatgaagctttctcagcggctgaaaagcttcgaaaactgaaaatccgcgccttttcgcctgaagccggcatttatcattatctcaatatggcaaaacggaatgaaaaaacggaattgcagggcagtgaagtgaagattaaaaagtatttttatgttctgcgtcctctccttgcctgcagatggattgaaacgttcggctccgtaccgccgatgtcatttcccgtactggccgatgccttattgacggatgaagcgctcatttctgaaatcaatatactgcttacaaggaaaaaaagcggtcaggagctggctccggaaccgagaaatacgatgattcatgcgtttatagaagaagaaatagaacgcatcgggcactatgtcaaaaccatcaaaacgccgaaacctgacataacggaggaactgaatcagctattgattcagaccgtcgaagaggcgtggggggaaaaaggcggaaattgacgattgccgtcatttccgtccgccttttttcggcataatccgcctgctatctaagaagctgattgtggtaaaaccacaaaaatttatcagaatctttgtatttttagaatattgtgagaggatgttttgtccatttacaatagactcatacaaatacttcttagattgcggggtgttaaggttggaagtgattacaagagattttttcttatttttatccaagagcagctttctcaataagatggcgcgaagctggggaagccgtgtggcagccggcaaaatcatcggaggaatggatttccgcagttctatcccgacaatccgacatttgaacagccaggggctgtcagttactgtcgatcatttgggggaatttgtaaacagcggtgacgtcgcgaaagaacgcaccgaggagtgcatgcagaccatcgccttaattgctgatgaacagctgaattcccaagtgtcattaaaaatgacgtctttaggtcttgatatagatctcgatctcgtctatgaaaatatgacgaaaatcctccagacggctgaaaaacataaagtcatggtgacgattgacatggaagatgaaacgagatgccagaaaacgctggatatctttaaagacttccggagccggtatgaatatgtaagcaccgtggtgcaggcttatctgtacagaacggagaaggatcttgatgacctcagcccgctgaatccgtttctgcggcttgtcaaaggggcctataaagaatcggaaaaggtggcctatcctgaaaaaagcgacgtcgatgaaaattataaaagactcatccgcaaacagcttttaaaaggacattatacggcagtcgccacgcatgatgacaaaatgatcgagtttacaaaacagcttgccaaagagcacggcattccaaacgaccgttttgagtttcagatgctgtacggcatgcgctcgcaaacccagctcagcctggtggaagaaggataccgcatgagagtctacctgccttacggggatgactggtacggctatttcatgagacggctcgccgaacgcccctcaaacatcgcattcgcctttaaaggaatgactaagaagtaaaaaagggagagatgacaatgactacaccttataaacacgaaccattcacgaatttccaagatcaatcgaacgttgaagaatttaagaaagcgcttgcgaaggtaaatgagtatctgggaaaagattatccgctcgtcatcaacggtgaaaaggtagagacggaagcgaaaatcgtatccattaaccctgcagacaaagaagaagtcgtcggaaaagtgtcaaaggcgtcccaggagcacgctgagcaggcgattgaagcggctgcgaaagcgttcgaagagtggagatacacatcccctgaagaaagagcggccgttctgttccgcgcagctgccaaagtccgccgcagaaagcacgaattctccgccctgctcgtcaaggaagcgggaaaaccttggaacgaagctgatgcggatacggcggaagccatcgactttatggaatactacgcgcgccagatggttgaattggcaaaaggcaagccggtcaacagccgcgacggcgagaagaaccaatatgtctacacaccgaccggcgtaacggtcgtcattccgccatggaacttcctctttgcgattatggcgggaacgacggtggcaccgatcgtaacgggcaacacggtcgttcttaaaccggcaagcgcgacaccggtcatcgcggcgaaattcgtagaagtgcttgaggaatcaggtcttccgaagggcgttgtcaactttgtgccgggaagcggagcggaagtgggagactatctcgtcgatcacccgaaaacaagcatcattacgtttacgggatcacgtgaagtcggtacgagaattttcgaacgcgcggcgaaagtgcagccgggccagcagcatttaaagcgtgttatcgctgaaatgggcggtaaagatacggttgttgtcgatgaggacgcggacattgaattggcggctcaatccatctttacatcagcattcggcttcgcgggacaaaaatgttctgcaggttcacgtgcagttgtccatgaaaaagtgtatgatcaagtattggagcgcgtcatcgaaatcactgaatcaaaagtgacggcaagccctgacagcgctgacgtgtatatgggacctgtcatcgaccaaggttcttacgacaagatcatgagctacattgaaatcggaaaagaagaaggccgtttagtaagcggcggcaccggagatgattcaaaaggctactttatcaagccgacgatcttcgctgaccttgatccgaaagccagactcatgcaggaagaaattttcgggcctgtcgtggcgttttctaaagtatcaaactttgatgaggcgctggaagtggccaacaatactgaatacggtttgacaggcgcggtcattacaaataaccgcaaacatattgaacgggcgaaacaggaattccatgtcggcaacctgtacttcaaccgcaattgtaccggagcgattgtcggctaccatccgttcggaggcttcaaaatgtccggcactgattcaaaagcgggcggcccggattatttggccctccacatgcaggcgaaaacaatcagtgaaatgttttaagagggactgaatgggcatcctcctcgcggggggtgtccatttcaccataaacctataaagcggaggaggaaatgccatagcaaacattcagttgattatttccatttgtatttatatggcgggcatgctgtttatcggttatttcgcctacagacggacgtcgaatctgacggattacatgctcggtgggcgttctttaggccctgccgtcacagcgctcagcgcgggagcggcggatatgagcggatggctcttgatggggcttcctggcgccatgttctcgacgggattaagcggcgcttggattgtaatcggacttgtgctcggggcttgggcgaactggcttttcgtggcgccgaggctgagaacgtataccgaaaaagcggggaattccatcaccattccgggtttccttgaaaaccgtttcggtgatcatacgaagcttctcagactgttttcgggtctcgtcattctcgtctttttcactttttacgtatcatccggcatggtgtccggaggtgtcttattcaacagcattttagggtgggattaccacaccggcctgtgggccgtgacaggcgtcgttgtcgcctacaccttgttcgggggctttttggcggtaagctggacggactttgtccaagggatcatcatgtttgcggcgcttattctcgtgccgattgtgacgattttccatacgggcggcccgggggaaaccgttgccgatatccgttccgtcaacccggaactgtttaatatgttcaaagggaccaccgtccttggcattatttctttatttgcgtgggggctcggctatttcgggcagccgcatattattgtgcgctttatggcgatcacatctgtgaaagagatcaaacgcgccagacggatcggaatgggatggatgattttgtctgcactcggcgcgctgtttacgggtcttgcgggaatcgcgtattaccaccagcgcgggttgaagctggatgatccggaaaccatttttattcagctcggcaatattctgttccacccgattattacgggatttctcatttctgcgattttagcggccattatgagtacgatttcgtctcagctgctcgttacgtccagttctttagtggaggacttgtataagtccatgttcaggcgttcagcttctgataaggaactcgtatttctggggagaatggcagtgcttgcggtgtcaatcgtcgccctggtgctcgcctgggagaaaaacaacacgatacttggtcttgtcagctatgcatgggcgggattcggcgcttcattcgggccggtcgtactgctcagtttattttggaaacggatgacgaaatggggggcactcgccggcatgattgcgggagcgattaccgtaatcatttgggcgaatgccggtctttcagactttttgtacgaaatcattccgggctttgctgtaagccttgccgctgtatttgtcgtcagcttattgacacaggctccgtcaaaagatgtcacagatcagtttcatgactaccgtgatacactttctcaataaaagcaaggaacgagaggaagaagggaccgccctttttcctcttttcacgatacaggctttcggatcattccgttttgggagtatatgaatttttttctatacaaaaagtcacccctcagagtatgataaagataaaaagagcataggagaaataggtatggaagagcttttagagagagttttttcatttacggacattgataaattaattgatttcatcagttatgaattgcagaagcccgttattctggaaagcgcggatttctttttgcttgcctataattcttattacattaatcacttcgactccgccaaccagcagacgatattctcaaaaaaatgccccgtgcagatttttgaaaggtttctgaaggacggggtgatcgaaaagctgaaaaccgttcctgaaccgttccgtgtcgaaaaaatagacagtatcggactgaatcagagagtggttgtaagcgcaaaacataaaggggaagtgatgggctacatctggattcaggagctcgaccgaaacttgacggacgaggagctcgattttttatatgaaacttcattccatgtcggaaaaatcatctataaaacgaaccggctgaaacaggaaaaagaagagagagcggaagacctggtgaaacgggcgatctttcagcaattctcctctgaaaaggagttcaggcgggaagcggaaaagatgaacgccgtgctgccgtcggttttttcggtagtcgtcctgcatgccgcaaatggggatggggaggcagtcgaagatgtaaaggaaaatatcaaatcgtacttgaatttgcgggataaagtcagccacgtcttaaccattgattccaatattgtcatcgtcgtcgcaagcttctcgcaaaaaagctccggcacttcggcagcatctgaattcatccacaaactgctgactcattttcactttcagaagatccccactcccatctatatcggaatcggcaatgaatacagcagcatcctgaagctcgggaaaagttatatagaagcccttgaagtcataaaggccgccgaaattaccggaaatcaggaaaatatcccgtacgaatacagtaagctcgggatttaccgctatcttgaaagcatcgaagaaaaaaacgcctcactggaatatgtaaacgatgatttagcgttattaaaagccaaagacagagaaagcagcaccgaactgctgaaaacgttagaaatctatctcctcaataactgcaaaacaaaaccagccgcagaacagctttttattcatcaaaacacattgaactaccgcatcaaacagattcttgacatgacatcaattaatttaaacgacttcaggacaaggtgccagctgtatctcgatatcatgctgatgaaaaagagataaaaaagaaaccagtcgccgtactggtttcagttttaataccttcccgcttatcaatctcagaacctcgcttctgaatcactcctttcccgcaagatgagaaatgaataaacactgctcctcaatatgtgttatactttcattgatattgattctcaattaaaaatgtatgaagtatagatataaacgggaggcagaacgatggcggaaaatcatgaggtgtatgacgtcacgattataggcggaggcccgatcggcctgtttgcggctttctattgcgggatgcgggagctgaaaacgaaggtgatcgagtttttaccgcggctcggggggaaggtgtctatgtttttccctgaaaaaatcatccgggatatcggcggaatacccgggattgccggggaacagctgattaagcagctgaaggagcaggcggcgacatttgagccggatatcgtgttgaatcagcgggtgaccggatttgaacggctggaagacggaaccattgtgctggaaagttccaaaggggaaaagcactatacgcgcacggtgattttggccgtcggcatggggacgcttgaggtcaatgaacttgacagcgcggatgcgagccggtattcaggaaagaaccttcattataaggtggagaagcttgatgcgtttcgagataagcatgtcgtgatttccggagggggagataccgcggttgactgggcgaatgagctggaaccgattgcagcatctgttaccgttttgcaccgccgtgaggagtttggcggtttggaaagcagcgtggcgaaaatgaagcggtcttccgtgcgggtgcttgcgccgtatcgtctgaagcatctcaatggcaccggggaacggatcgagagcgtcaccgtttgccaaactgagtccggactttctgaagtcatcaagcttgatgagctcattatcaaccacgggtttaaaattgatctcggtccgatgaaggactgggggcttgagatagaagaaggcaggattaaagctgacagacatatgcggacgaatcttccgggcgtgtttgtcgccggtgacgccgcccattatgaaagcaagctcagattgattgccggcggtttcacggaggggccgaccgccgtgaacagcgccaaagcctatttggacccgcaggcggatcagatggcgatgtattcgactcatcataaaaaattggtgacacaataaaaaagggctgacccccgatgttgagcccgggggtcagaaaagcattccggcgtatcagctgtgaacgagcatgtctttcatttcatttcgtataaacgcaaataactgttcctgatttttcacggcggtaaacccgcagccggcggggacgtcttcgcccatgcagatgacgggagggcggtttcctgacggattcggtgatatgccgatttgttttccggcgctgatcaaatgctgagcggattctttgcccgtacagataatcatttgcagaggagactcactgatcgtgcgttcgatcatggaagtgaaccgctcatccgcgatatgttcatgggtgatataaaacgggcatgattttgagtctgacaagttttctgctgcttgacggcttcctacaatgagagaatgcggagaatcattttgccattcggataggagaaagccccgttttgtcagttccgtctttgcggcttcagtcgctgcattcaggcttgcggtcacccggcggatgtcgatctgcttgaaagccagtgtgtcaaagaattcgcataccgcaaggcgtgatgtgaaaaatagttgttcaaaggtgctgatctgtttcaggatgttttcgtttgcgggcatttttttaacgatccgcttcggccattcaataacatcggcgccatactcgcgcagcttgtctgtcagtgtatgttcatcatcgccatgagtgaccaccatgatatgccgcccgatgaagggtttgctttcaaaccagctgtgtgtttgaaaattgacaatatcaccgatgacgataatggcagggttggtgatgttttggctttgaactttgtcatggatatcctgaagcgttcctttaacactccgctgccgccccacgttccccattgaatgacgagtacgggaatggaaggggattttccgtactccataagcttccggcatataaatgacagatttttaacgcccatgtaaaacacaagcgtttgaacgcttcgggcaagcccttcccagtcgagattcggcctgccgtgcaatgatgtatcatgagcggtgatcatcgcgaaggacgaagcgaaatcacgatgggtgacggggactcccgcatacagcggcactgcaattcccgaggtgatgccgggcaccatttcgtagcggatgccatgctgatgaagcgcctctgcttcttcgccgaccctgccgaacacacttgggtctccgcctttcaagcggacgacggtgtagccctccgccgctttttctatcagcagggcatttatctcagactgtttcataaaatggcggtcgggcagctttccgcaataaatgaaccggcagtccggtgaggcgtattctagaaactttgggtttgcgagccggtcatacaaaatgatatccgctttctccagagcctgttttccttttacggtgatcagccccgggtctcctggtccggcaccgacaaaatatacgattccgtttttcatgatggcgtcatcccttcagcaatttaaaaaatgaaggaccacttgaaaaagtgatccggtctttgatcaatacaggaggtatacattctctccttcgatcagtgtttcgtatgttttgacacagccatggtccggctcttggacttttccgtctcctaaggaaattttccagtcatgcatcgggcagaagacgtattctccgctgacgatgccttcagccaggacgcctcctttatggggacagcggttttcgacggcgcggacgttcccgtcagaaagcttaaatacggcaagctctttatcttctatatatacggtttttcctaactcctcgggtaattcgtttactctgcctatgcaaacctttgtcatatctttattaaccatgtccgttcccccttactgttttatgaagtcgtgacgacattttcgaatagatctttagatgcttttttatcttcaaggaagtattgccacggatctttgtggacagagagtgtctcattcattctgtcgttgagctcctgccgtttttccggatcgtttaatacggattggacatgagataaaccgacgcgctcaagccatgcggatgtccgctccagatagtttgccgtttctctgtagtactgaaggtaagcacccgcgtattctaagacttcttcattcgtttttactttcatcagcaaatcaccggcgcgcaaatgggttccgccgtttccgccgacataaagctcccagcctccgtcgatgccgacaacaccaaggtccttaatgcctgattccgcacagttccgcgggcaggcggacacggccattttaaccttatgaggcgtattgagcccttcgaattttttctcaagcgcaatacccagtgccatggaatcttgcgtcccgaagcggcagaattgttcgcctacgcacgtttttaccgtgcggagtgtttttccgtacgcgtagcctgacggcatatcaagctcggcccatactttcggcagatcttcttttttcacgccgatgagatcaattcgctggccgccggtcattttaacgagcgggatctcatatttgtcgacgacatcggcgatcttgcggagatcttgagagttggttacgcccccgtacatccggggaacgactgagtatgttccgtccttttgaatattggcgtgcatccgttcgttcacaaaacgggatgttctgtcatcctcgtatgtagccggattaatcatgcctaagtagtagttgagggcagggcggcatttggagcagccttccggcgttttccagccgagcacgttcatgatttctcttgtatgtgagagccctttggctttgatttcttctacgacttcatctctcgacagtgaggtgcagccgcaaatcgcttctttttgcgcggatgagtcaaattctgagcccagtgtatattgaagaatgtcttctacgagcggtttacagcctccgcaggaacgggatgccccggtgcatgctttgatttcgtccgttgatgtgcagcctttttcctgaatggcttgtataatcgcgccttttgaaacgccgttgcagccgcagatgatttcatcgtcgctcatcgccgcggtcatgcttgcgcctgcttcctgatcaagaggctgtaagattgatattttggaggtttcagagatatctgcttctttttgaatcatagaaaacaggcggttgccttcgctgctgtctccgaacaaaacagcgccgacaatttgattgcccctcaggacgatttttttataaatgccgtcctgttcatcgaacactttaattgcctttttgtcctctgattcatcaaagtcgccggcagagaagacctcgacgcctgatacctttaattgagtggagagaacggagccttcgtacggttttgtttcaatgccgcaaatatgcttggccagcacttttgcctgttcatagagcggcgccacaagaccgtatgcgattccgcggtgctcggcacattcaccgaccgcgtaaatgtgcggaatttcagtctgcatataatcgttaacaatgattccgcggttaaccgggatgccgctttctgtgccaagctgtgtattcgggcggatgccgacagccatgacgaccagatcagctttgatgcttgtgccgtctttgaagcgtacgccttcgacacggtcagtaccgagaatttcttcggtttgtttttcaaggaaaaaggtcatgccttgtttttctaactcgttttgcagcaggcgtcccgccgctgcgtcaagctggcgctccatcaggaatggggcgaggtggatgacagacacgtccatgccgagattcagcagtccgcgcgcggcttccaaacccagcagtcctccgccgatgacggctgcttttttatattgttttgacgcggcgagcatcgtgtcggtatcttttatgtctcggaatgccgtgacgccttgtttgtctgcgcccggaatcggaaggataaaagggacagagcctgtcgccaggatgagttcatcgtaaggctggattctgtctgcatcggtgatgacggttttgttttccgtgtcaactttgatgactgtttcaccggtgtacagctgaatgttgttttctttgtaccagttccaatcgtttaacgtaatgtcttgaatgtcggtatcgccttgcagcacttttgacagaaggattcggttatagttgggatgaggttcggccccgaatattgtaatctcaaattcatcttttgaaacacgcagtatttcttcaatcgctcttaccccggccattccatttccaacaaggactagctgtttttttcccatcagatgatccgctcctatctttgtttttttcagcgtagcacagcaaaaacaaatatttaagatgcatgttatgaaatgtaacaaaaaatacgaaaaaatctaaaaattttatgaaaaattagatagggctgattcgtaccgcacacatcttaaaaccgggcattttacagtccggatcgaaggcttcaccaattaaatcgttgacgttttgcgtgtcagaccaatggatggggacaaacaatgtatgatgtctgacttttacttgatttttaacggagaatatatcaaaataaatagtaacaattacgatttgtagccatgtacatcgtgataataagggagttgcgggatataaatcgtaatcattctattttgtcaggaggctattgatatgaaaaaaattccggttacagtattgagcggctatcttggtgccggaaagacgaccgttttgaatcatattctacaaaaccgcaacggtttaaaaattgccgtcatcgtcaatgacatgagcgaagtaaatatagacgcgggcttggtaaagcagggaggcggtttgtcaaggacggatgagaaactcgtggaattatccaacggctgtatctgctgcacgctgcgtgaagatttattagtcgaagttgagaaactcgcgaaagacggcaggtttgattatattgtcattgaatcaacagggatcagcgaaccgattcccgttgcccagacattctcttatatagatgaagaaatgggcattgatctgacaacattctgcaggctggacacaattgtgaccgtggtggatgcaaaccgcttctggcatgatttccagtccggtgacacccttcttgaccggaaggaagcggcgggagaagaggatgaacgggtgattgccgacttattaattgaccaaatcgagttttgtgatgtgctcattttaaataaatgcgacatggtgggcgaaaaagagcttgaacagctggaaacggttctttgcgcattacagccccgtgccagactgatccggtccgtccgcggagaagtgcccgccgaatgcatattgaataccggtttatttgagtttgaggaagcgagttcatcagcagggtggataaaggaactgacggcaggtcatgaagcgcacactccggaaacggaagagtacggcatcacttcgtttgtgtactcgcggcgtctgccgtttcataccgttcgttttgacagctggctgcatcaatcaatgcctgacaacattgtgcgcgcaaaaggaattgtttggtgcgcaacccgcaacagccttgcgctgctgatgtctcaggcgggtccggcggtttcgattgagcctgtttcttattgggtggcggcaatgccgaaacttgagcaggagcagatcaaacagcaggaaccggagattctggaagattgggacgaccaattcggagatcgtcatacgaacctggtgtttatcggaacagatttagatgaagccgccattacaaaggaattggatcagtgcctgctcacgccgtctgagttcgattccgactggtcgcagcttgaagatccttttcaatgggatattcagcgggctgaatagcataccggccaagtttagaagcaggtgaaaagggaaggagtgatgaaaaaggagctgaccaagtgtgaaagcattgacataccaaggaaaagaacatatggaagtgaaagaagtcccggcacccgccactcaagatgagagagatgtcatcgttcgaattaccgcaaccgggatatgcggttcagaccttcatttatataaaaacggaatacccgccgatccgggttatattgtcgggcatgagccgatgggaatcgttgaagaaacgggcagtcaagtcaaaaagctgaaaaaaggcgaccgggtcgtgattccttttaacatcggctgcggagaatgtcattattgcaagcaccagatggaaagccagtgtgatgaatcaaatccaaatcctcatacagatgccggcggtttattcggtttttcggagtttaacggaaattatcccggcggacaggctgaatatttacgtgttccttacgctgatttctcttcttttctggttccggcagacagtgagcttgaagatgagcaggtgctgcttctgtcagatgtcatgccgaccgccttttggagcgttcagcacagcggagtgaagaaaggagatacagtcgttattctaggatcaggtccgatcggcttaatggcgcaaaaattcgcgtggaaaaaaggagctaaacgggttatcgcagttgatcaagtcccgcaccgccttgaacatgcgagacgcataaacggagcagagaccttcaatttttcagaacatgatgagatcgggaaactgctgcacgaacaaacgtcagggggcgcggatgtagtgattgattgtgtcggaatggacggcacgccgctttcaaaagaaaaagcagagcaaaaaccgaatcagttcggaacgatcagcccgattcttacagcatcagaagccgttaagaagttcggaaccgtgcagctcacgggcgcatacatttctgaagcggacggctttccgctcggcgattttttcacacgcaacgtttctttaaaaatgggccaggcacccgttattcatctgatgccgatgctgtatcaaatgattgaacaaaatgaaattgatccgacggatatcattacacacaaaatgagtcttgcggaagctcctgctgcatatgatatatttgacaaaaaagaagatggcaacattaaagtgattttgaagccatagcgaggggaaacatgatgaatatttacagaccggcgggattttggatcagattgggagccgttgtactcgactatttaattacttcagtgcctttggcgattatttttatgctggcaacaggaaaagatccgaatgagagcgcaatgatcagcatcattttgactctttatggtattttgctccctgtatactggaacggttatgttatcggcaaaaagatctgcggtatccgcatcgtcaaaaaagacggaactcaggtaggctttctcactatgattttgagagtgcttgtgggcggcctgatatatggcgtgacgtttggaatcggtgtgatcgtgagcgcattcatggtcggaatgagagaagacaaacggtcaatccacgattttgtagcgggaacgtatgtcacatacgcgctgccggacgaatcgattgaaaagagcgaataacttcgctcttttttttgcataaaaagtggatgagggagcaacatataacaaacgttaaaggaggagagagtcatgaaaaaagctgcattgtctttagctgcgtttttcattacagcaatggttttcacaatgccggcacacgccgaaacaaaaatgccttcaacaatgtcactcacggaacagcagaaaaaagaaattgaatcacttgaaaaagaagtgctcgaaaaacgcaaacatgtcatatccaaatatgttgagtacggggtcctgccgaaagaaaaagcagaacatattaaacagcatatggacaggcgctttaatatgatgaaacaaaatggctttgtcccgaagcctccgcctcataaattggaaaagcggcatcatcattcttaagcatccggcaagccggatgcttttttatcgggattgctctgaaatgagtttcataacgtgtgatatcaatatcatacgcatcaggaggatgaaacacatggtacataaaaaacagggtctgttccctgatacatttctatgggggggcagcttcgtctgcctatcaggttgaaggagcttggaataagacggtaaaggaccttcagtatgggtgaacagtgcagagtggctattagtgacggagttcatctcatcggctgctgcagctggtcattcacggatctgttaagctggctgaacggctatcaaaaacgctacggttttgtgtataatcaatcgagataaagaagatgaaaaggatttgaaacggatcaggaaaaaagtttttattggtaccagaatgtaattgaaacaaacggtaaaagtttataggaaagttccctgagagaaatatgattctctcagggctttcttttacattgcgtctgcatcaataatatacgtatctgcatgaagatcggatatttcggcaggcactgaataacaggtaaggctgtatcggcctttcggaatattaaagaaaagccgctttgacatcacgctttcaatctcaattccatcttttacagcctcaaagggaacagtcgcttttttctcataggatagtaccggttcacttgtgttaagcctgaggacgataaatgccctcgtatttctccttgcttcaaatgaaacagctccgtcagcttccgcatatcctttttcaatggcttcatcggtccaatcgataacaggcggttctgaatctttttggaagattgtaaattgatgataagaaatggccagttcttgcggtttccatgatttattcaatgcgctgttcctcctgtttttttacttgattttaaataatactctcgttccgtcgggatcattggtaagctggtgtccgacccaagagccggctccgcggttgtctgccggagaaatatattctacggaggcattgtttccgccctgttgacaaaccgccatcggccattcatccctatcgtatcccgttttgacaggcacatgtttaagagattgctcacgccgcttatgtactccgtctctgtcaatggtgcatatgctggaatgcccttcttttatcgcgtccttaatatgctttgctgtttccggatatcgatcggacggaaataggattactttatcgtaatcactcttctgaacggtctgctcgttatctgagaaaagatcacccttgatcagggccgcgactgctccggcaatgatgataagaacaagcagcagtgcttttaatgttttcaagagtatcaatcacctccagttttaaattgctgtaaagctggtccaagaataaagcagaatcagccggctgtaaagctgttaaaatatatttctcagccgcaattcagctgaatatctgtaaaaccatccgcacaaatcaattttattcattaaatatccgatcagaaagtgttttttgccgtttctctattcagaaatgaacggttgcggccgtatcgtcaattgacttattatagcgataagctcaccggcaggatatcttcgtctgcgagtgtccgacccgaaaaccttggcttgcatgaccgtgcgcaacaagacgataaaaagacggccatctgataagaaggccgtcagcaaatcattccagattcgcatgctttgtaaacatgtctgctgaattcaattcttttttctccatgatttttagaataaccgcatcgtaaaacagcaaaagagtttgttcgaataaagaacccatcggctgaatcgtctttctgtctccgccggtctcttccttaggagagccgggaatcgttatcgtaagatccgcaagtttgccgagacttgaatcggggttaatcgttaatgcagtgatgatgccgttaaggcttttggctttttcagccgtatgaagcagactttttgtttcgcctgagcctgagccgatgatgacgagaccgccttcttggaggggaggggtaagcgtctccccgacgatgtaagcgttcaggccgatgtgcatcatcctcatggcgaacgctttagccataaagccggaacgccccgctccggacgtgaagatttgatctgctgataaaatctgatccgcaagcttgtcagcttcactgtcggctattaatgctgcggtgcgggatatttcattgagtatttcatgtaagtattcagtcgttttcatgatccttgtgaaatcagctgtttcattttagcagcagcatccgctttattgtcagctcccgtaatgcctccgccgacaatgattaaatctgggttttgtttgatggcttcaggaagcgtatcaagtttaatgcccccggcaattgcggttttagcgctcttgaccgcttttttaatcgccgtcagttcctcgaatgaattctttccttctgcttgaagatcataacctgtgtgaacacaaatataatcaacaccgagttggtcaatttcttttgcacgtgtttcaaggttttttacgttaatcatgtcgacgagaatttttttctgctgtttttttgcttcggcaaccgcccctttgatcgttgagtcgtctgtcgctcctaaaacggtgatgatgtcggcgcccgcttctgccgctttcatgatctcgtagccgcctgcatccatgattttaagatcggcaagcactttcaagtgaggaaaggctgatttcatttcctgtacggctttcaggccttcattaatgacaacgggagtgccgatttctacaacatctatatattgttcgacctctttcacaagttcaattgcttccgggatattcactaagtctaatgccagctgtaattccactttatatccactcctcttttttgtgtatttacattctatagagtgccccgcatgttgagaagtacgcactttgaagtctaatagttactttgaggatactgtccccgcaggcaatgcgctttgtttcagcaaaactgcgtggtagtataaactgatgaaagttgtgtaaaaaagtaagcgtgtatgaatagatgacgaacgtacaaaaagtaagaggaaggagaatggcccgtgagccgaatggataagaaaacgtttaattgcgaaaaggaattgacgcttgccgtgataggcgggaagtggaaaatgctgattatgtggcacctgggaaaagaagggacaaagcgttttaatgagctgaaagctttaattccggatattacgcacaaaattcttgtgaatcagctcagggagctggagcaggatctgatcgttcacagggaagtttaccctgtcgtccctccgaaagtggagtactcattaacggagcaaggagagacccttatgccgattttggatgccatgtataagtggggaaaagaatatatggaattaatcaacattgataaaactgcaataaaggaatctttttgaagcgctctatgtaaaatagagtgctttttttgcggtttaatgaaatcatattgcgaacgattaaatctcctgtttcggttcttgcgctgttttttccccatcagctaatatatgaaaactattttcattctgccataactggatattcgaaagatttatactatagtttaaagatttttaattttacataaataatatttttaaaaataaattgcgggatgccgcaaaataccctctggaattgtcggaatttttttcggtgtgccgaatgaaacttttcacccatttttcggtgataaaaacaataatttcatataaagtgaacgtaagtagatatatagtaattcatgaagaaataggtaaaccctgttgcttacaaacattggattcttgtcttgatttctcataaatttgagccgcatttcggactgtgcgggtgagtggattgcggatttcggcggtgattgaatcgggatcgttttggaggtaagtggttcttttggcttgataatgagttagggacattgagggaggctgtttctaagggagaattgacaattttatcttaaaaaggggaggcgcacacatatggaaataactttttatcctttaacaaatgctcaaaaacgtatctggtatacagaaaaattctatccgaacacaagtatttcaaatcttgccgggttcgggaaactcatttctgatgacggcgtacaggctcattacgttgagaaagcgatacaggaattcgtccggcggtatgagtcgatgagaatccgtctgcggcttgatgatgagggggagcccgttcaatatgtgagcgaataccgtccgctgactatcgaacatacagacatcaggcaagccggctgctctgcggaagagctgtcaaaatggggacgtgacgaggcaagcaagcctctggcattatatgatcaggatttattccgtttttccgtgtataccatcagcgaaaatgaggtctggttctacgttaatgtgcatcacgttatttcagacgggatttccatgacgattctgggcaatgcgattactgatatttatttggagctttcgggcggatcaagtgaggaacagacggagattccttcctttatcgagcatgtgctgactgagcaggaatatgtgcagtcgaagcggtttaaaaaggatcgggatttttggaacgggcagtttgagaccgtgccggagcttgtgtccctgaaacggagccaggcagatgcgggtcttgatgcgaaacggttttctcaagaaattcctcacgacttatatggccgcattcattcattctgcgaggagcataaagtcagcgtactatctctgttccaatcagctctgatcacttatctctacaaagtgaccggccgggatgacgttgtcacaggtacgtttatgggaaaccggacgaatgcgaaagaaaagcagatgctcgggatgttcgtatctacggtgcctgtgcggacaagcgttgacggaggacagtcgttcttggaattcgttaaaggccggatgaaggatctgatgaaaattctccgccaccaaaaatatccgtataacctgcttgtcaatgatttgcgcgcttcgaaaagttcgctgagcagattgtttacggtagctctggagtaccaggtgatgcagtggcagaaaaaagagaatctgtccttcctgacagaccctattttcagcggaagcggtacaaatgatatttcgattcatgtgaaggaacgatgggacactgggaaattgacgattgattttgactatcgcagcgacatattcaagggagaggagattgtatctgtttctgaacgtttgatcacgctgattgaagatgcgatttcatctcctgatcgcataattgatgagcttactcttctttctgaatccgagaaagagcggctgctgacacgggcctccggcaatccggtgaattaccgcggggagatgacgataccggggctgtttgaagagaaagtgaagtcactgtctgacaaaccggcggtggtgtatgaaggccgaacattgtcctatcgcacattgcatgaacagtcaggccgaattgccggacgccttcttaaagccgggatatcagccgatactcctgtcgcggtgctgcttggccgttctgagcgtgtcattgcggcaatattgggaattttgaaagcgggcggcgcctatgtgccgatagatcctgattttccggcggatcggattcagtacattttggaggacagcggagcgaaggctgttttgacggaggccggaatacaggcgcctgtatcggatgccgaaccgattgattttgacgaggctgttcagtttgaaacggctgcggacggtgtcagcacacaatcagaccggctggcttacatcatctacacgtcaggtacaaccgggcggccgaaaggcgtgatgattgagcaccggcaagttcatcatctggtgcaatcactgcagcaggagatttatcaatgcggtgagcagacattaagaatggcgcttttggctccgtttcattttgatgcgtccgtcaaacagatttttgcctcgcttcttttgggacagacgctttatatcgtgccgaaaacgactgtaacgaatggctcggcactgctggactattatcgtcaaaaccggattgaagccactgacggaacccctgcgcatctgcagatgatggttgcggcgggagatgtcagcggaattgaattgcgccacatgctcattgggggagagggcctgtccgccgctgttgctgaacagctgatgacgctctttcatcaatcgggcagggcgccgcgtctgacgaatgtgtacgggccgacagaaacgtgcgtagatgcatccgtgcatcaggtgtcagccgataacggaatgaatcaacaggcggcgtacgttccgatcggaaaaccgctcggcaacgcccgtttgtatatattggataagcaccagcggcttcagcccgacggcacggccggtgagctgtatatcgcgggtgacggtgtaggccgcggctatttaaatcttccggatttgaccgcagagaagtttttgcaagatccgtttaacggaagcggccgcatgtaccgcacgggtgatatggcgcgctggctgccggacgggacgatcgaatatatcggccgtgaagatgatcaggtgaaagtccgcggctaccgtattgagctgggagaaattgaaacggtgctcagaaaagctccgggcgcggcgcaggccgtcgtgctggcacggccggatcagcagggcagcttagatgtttgcgcatatatcgttcaggaaaaaggaaccgagtttcaccctgccgagtacagggagtatgtgtccaagcaccttccagattacatggtgcccgcttactttacaaaaacggacgaaattccgctcacgccgagcggtaaggcggaccgcaaaaagctgtttgcgcttgatgtgcaggctgtcagctcatccgaatatgccgcgccgagaaatgaaacggaggaaacgctcaccgtcatctggcaggaagtcctcggaatggataaggcgggcatttatgatcatttcttcgagtcaggcggtcattcattaaaggcgatgacgcttctgacgaaaattcataagcaaatgggcgttgaaattccgctgcaatacttgtttgagcatccgacgattgcggcgcttgccgattatgcggaaaaccgaaacgaaggacaggcattcagtgcgattgagccggctgagaagcaggcgagctatccgctttcgctcgctcagcagcggacttatatcgcgagccaatttgaagacgcgggagtcggatataacatgccggctgcggccatgattgagggcgctttagaccgtgaaaagcttgagcgtgcattttctgccttaatcagcaggcatgaagcgctcagaacatcgtttcaatcagaggacggcacgccgagacaggtgattcacgaacatgttccgtttcatattgaaatgatcgaagcgcgcggaagaacgaatgaacaggtcatgaaggactttgtgcgccgttttgatttatctgaggcgccgctgttcagaatcggcctgcaaacgctcggtcacaatcgccatatgctgctgtttgatatgcatcacctgatttctgacggggtgtctatttccatcatgctgaaggaactggctgacatctacggcggaaatcagctgcctgatttgcgcattcaatataaagattatgccgtatggcaggcggaacgggcgaaagaaggctacaagaaggagcgggcgtactggaaagaagtcttcagcggcgaactgccggtgcttcagctgctccctgattatccgcggccgcaggtgcaaagctttgaaggtgaccgcgtgtccgtcaagctgccgaaaatgctgcgggaacggctgcagaagcttgccgagaaaaacggagccactctttacatggtgctgttatcggcatactatacgctgctttctaagtattcgggacaggaagacatcatcgtgggaacaccgtcagcgggaagaaatcactctgataccgaggggcttatcgggatgtttgtcaacacgcttgcgctgcgaagctccgtgaagcaggatcagacatttgccggcttgttaggtcatgtgcgcaagcaggtgctggacgcgtttttccatcaggattatccgtttgagtggctgaccgaggagctgaacgtgccccgggacatgagcaggcatccgatatttgacacgatgttcagtctgcaaaatgcttcggacggaattccggagatcggcaacctgacgctgtctcttcatgaaaccaacttcaatatcgctaaattcgatctgacaatgcaggcccgggaaacagcggaaggcattgcgctcgatttggattattgcacgaagctgtttaagcgctcaactgcggatcgcatgcttgcgcactatgtccgtctgctggagagtgcggcagctcagccggatgcgaaaatcagcgaatatgatctgctttctgaacgggaggctttgaaccaattacagcggttcaatccggagcgcacggcatacccgaaagagcaaacgatcgtgcagatctttgaagaacaggcccgaaagaaccctgaccggacggctcttcagttcgaaggggaaactctgtcgtatcagcagctgaatgaacgcgccaacaggcttgcgcggcatattctttcggtcggaggcggcgggaaaaccgcggctgttttatgtgaacggtcaatggacatgattgtttccattatggctgtgttaaaagcggggtccgcctatgtgccgattgatcctgagcatccggttcagcggattcagcatttcttccgcgacagcggggcgaatgtgctcctgactcagcaaagcctcaagccgcttgcggaaaaggccggttttcaaggcgtcattgtgcttgctgatgatgaggcgagctatgaaaaggactctcgcaatccagcattgccgtttgattccaaaacgattgccaatctcacttatacatcaggcacgacgggaacgccgaaaggaaacatcgtcacacatgccaacattttgcggacggtaaaaaacacgaactatttgaccgtttctgaagaggatacagtgctcggtctgtcaaactacgtctttgacgcttttatgtttgatatgttcggttcgctgttaaacggtgcaaagcttgtgatcgtcccgaaagatacggtgctggacatgtcgcgcctgtcccgtgtgatcaaacgggagaacgtcagcattctgatgattacgacggccctgttccacctgcttgttgatatggagccgtcctgtctgacgacgcttcggaaaatcatgttcgggggcgaaagagcgtctgtagaacatgtcaaaaaggcgctggcggcagtcggaaaaggaagactgcttcatatgtacggtccgtcggaaagcacggtgtttgcgacataccatccggtggatgtcattgaagaggatacgctctccgttccgatcggtaaaccggtcagcaatacggaagtctttattatgaactcagccggacgcattcagccggcgggtatcgcgggagagctgtgcgtcagcggggaaggtctcgtagaaggctactacaaccgtcctgaactgacggaagaaaaatttgtaaagcatccgtttaaggaaggtgaacggatgtataaaacgggcgacttggccagatggcttccgaatggcgatatcgagtttatcggacgtatcgaccatcaggtgaaaatccgcggtcagcggattgagcttggcgaaattgagcatcagcttcaaagccatgaccagattcaggaatgcattgtgctcgctgtggatcaaggcgcgggtgacaaacttctttgcgcgtattttgtcggcctcagggaaatctcttcccgggagctgagggagcatacggcgaaggatcttccggcttatatgattccgtccgtctttattcaattggatgaactgcctcttacagggaacggaaaaatcgacagacgggcgctgccgatgccggatgtgaccgcagcgaatgccgtgtcatatacggcgccgcgcaatgaaacagaacaaaaactggcggatatttgggctgaggtgctgcaaatggaacgggtcggcgtccatgatcagttctttgagatcgggggccactcgttagcggggatgaaactgctggcccttatccagaagacattcggcgtgcagcttaccttaaaggatctgttcacttctccgacggctgcggggctggcgcagctgattgaaggggctgaacggaaggcggctgagagcatcgcaccggcggccgagcgggaaacgtatccggtttcttcaccgcagaagcggatgttcgtgcttcagcagctggaaggcgctgaaacaagctataacatgccgtctgtgctccgcttaaaaggaaagcttgatgcagaaaagctgaaatccgttatgaaacagctgacagaacgccatgaagccttcagaacgacatttgacataaaggatggagaaacggttcagcgtatatgggcggaagctgatatcgacatggaatattatgaagcctctgaagaagatgctgaacagattattcagagctttatccggccgttccgtctggatcagcttcctctcgtcagaacggggctggtcaagctggctgaacatgaccacctgctgctgtttgatatgcaccatatcatttcggacggcgcttcagtcggcgtgctgatagatgaactgtcccgcttgtatggcggcgaaacgcttgagccgctgcggattcattataaagactatgcggtatggcagcagaaatttattcaatcagagcagtaccgcaagcaggaggagcattggcttcgggagcttgacggcgagcttccggtattgacgctgccggctgattacagccgtccggccgtgcaaacctttgaaggagacaagctggtcttttctctgactgaggaacagacgtcggctcttcgcagtcttgcgaaacaaacggattctaccatgtacatggtgctgctggcgtcgtacagcgcctttctctcaaaactgagcggacagcatgacatcattgtcggctcgccggttgcgggacggtcacatgcggatctcgcaaacgtcatcggtgtttttgtgaatacactcgcgcttcgtacgtatccggaagcggacaaaacgttcacggactaccttaaagaagtgaaacaaaccgctttacatgcatttgacgcgcaggattatccgcttgaagaccttctgcaaaaggttgaggtgcagcgtgatacgagccgaaatccgctgtttgatgcggtattctcaatgcaaaatgcaaatgctgaagatctggtcatggaaggaattgagctgaagcaccatccgtttgacagaaaaacagccaagtttgacctgacgatgacggctgaggacacagacgaaggcttaacgtttgtgcttgaatataacaccgcgctgtttaaaccggaaacggcagagacgtggaagcattattggcttcaactgttaaaagccgcaacggaaaatccggctgcgaagctttctgagctttcattggtgaatgaaacagaaaaacaagccctccttgacgcatggaaaggaaaaacactctctgtgccgcgggacaaaacggttcaccgtctctttgaagaaacggccgcccgccacgcgaaccggccggccgcggcatacaacggcgcgaaatggacgtacggcgagctgaacgcaagggcgaaccggatcgcgcgcattctcatggattgcggcgtctcggctgacgaacgtgtcggcattttaacgaaaccgtccttggaaatggccgcgggcgtactcggcgtcttaaaagcgggcgcggcatttgtgccgattgaccccgactacccggaagagcgcatcagctacattctgcaggacagcggcgccaagctgcttctcacacaggaagcgctggacgtgccggatggctacaaaggagaaacgattctgcttgacggcggacgctccattctgagcctgccgcttgatgaaaacgatgaagcgaacccgcagacggaaacaacggcggatcatctcgcttatatgatttacacgtcaggaacgaccggacagccgaagggtgtcatggtcgaacaccatgcgcttgtgaacctgtgcttctggcaccacgacgcattcgccatgacggcggatgataaaagcgccaaatacgcgggcttcggttttgacgcctccatctgggagatgttcccgacatggaccatcggcgcggagcttcacgtcattgacgaggcgatccggctggatatcacccgcttaaatcactatttcgaggagaacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggctatcaggtgcagccggaaggcattgccggtgaattgtgcgtggccggccgcggtctggcacgcggatacctgaaccgtgaagaagaaacggcgaagaggtttaccgcagatccgttcgtgcccggcgagcgcatgtaccggaccggcgacctcgtcaaatggaacgcgcagtgcggcatcgaatacatcggccgtatcgaccagcaggtcaaagtgcggggctaccggatcgagctttcagaaatcgaagtccgtctcgctcagcttgcggacgttcatgacgcagcggtgacggctgtggaagacaaagcgggcaataccgcgctttgcgcctatgtcgcgcctcagcagaacgatattgaagcgctcaaagccgcgctgaaagacacgctgcctgactacatggtgccggcgttctgggtggagctggccgagcttccggtcaccgcaaacggaaagattgacaaaaaagccctgccggaaccggacattgaagcgggaagcgccgcgtataaagcaccggaaacggaaatggagacgctgctttctgacatttggcaggaagtgctcggtcttgatcagatcggcgtaagcgataatttcttcacgctcggcggtgactcgatcaaaggcatccaaatggcgagccgcctgaaccagcacggctacaagctggagatgaaagatctcttccagcacccgaccatcgaagagctcgtctcttatgtggagcggacggaaggcaagcaggccgaccagggacctctcgaaggcgaagcggacttaacgccgatccagcgctggttctttgagaaaaacttcacggacaaacaccactggaaccaatccgtcatgcttcacgcgaaagacggctttgatccggagataacagaaaaaacattacatgtcctgacggtgcaccatgatgcgctccggatgatttatcgtgaacaaaaaccgtattacagagggcttgaggatgcgtctgttgaactgaacgtctttgagctgaacggacctgctgaagaccatgaggaccgtatcgaacgagaagcagaccgtcttcaaagcagtatttcactggaaacaggacatctgctgaaggccgggctcttccgggctgaagatggagaccaccttcttctcgcaatccatcacttagtcgtggatggtgtatcttggcggattttactggaggacttcacgtccgtttatacgcagctgaagcaaggcaatgaaccggcgctgcctccgaaaacacattcattcgccgaatttgctgagagaatcaaagaatacgcaaatacgaaggcgtttctgaaagaagcggattactggagagagcttgaggaaaaagaggtatgcactcagcttccgaaagacaggcagtctggtgatcagcgcatgagacatacgagaacggtcagcttctctctgacgcctgaacaaactgaacagctgacgacaaacgtacatgaagcctaccatacggaaatgaacgacatcctgctcacggcgctcggactggcgctgaaagagtggacgggtgaagacacgatcggcgttcatttggaaggccacgggcgcgaagacattcttgacggcctgaatatcacccggacggtcggatggtttacgagcatgtatccgatgatccttgagatgaagcacgccgacgatctttcatatcagctgaaacaaatgaaagaagacatcagacacatcccgaacaaaggagtcggctacggcattctgcgttatgtaacggcgcctgagcataaagagaatctttcatttaagattgatccggatatcagctttaactacttaggccagtttaatgagatgtcggattccggcttatttacaagatccgggatgccgtcaggacaatcgctgagccctgacacagagaagccgaatgcgcttgatattgtcggatttatagaaaatgggcagatgacgatgacgtttgcctatcattctctcgaatttcatgaaaaaaccattcaatcgttcagtgacagctttaaagggcacctcttgaaaatcatagatcactgcctggcccaagacggacctgagcttacgcctagcgatcttggcgatgatgatctgacgcttgatgaacttgataaattaatggaaattctctaacagaaaagacagaggtgacatatgagcaaaaaatcgattcaaaaggtgtatgcactcacaccgatgcaggagggaatgctgtatcatgcgctgcttgatccgcattcttcctcctacttcacacaattagagcttaggattcacggaagctttcagcttgagctttttgaaaaaagcgtcaatgagctgatccggacatatgacatcctgcgtacggtattcgtgcaccagcagcttcaaaaaccgcgccaagtcgtattagcagagcggaagacgaaggtgcactatgaagatatcagtcaattagatgaagcgcgccaaaccgaatatattgaacgctataaacgcgatgtgcagcagcagggctttcatctggcgaaggatattctctttaaagcggcggtgttcaggctcagtgagaaggagctgtatctcgtctggagcaatcatcatattgtcatggacggctggagtatgggcgttttgatgaaaagcctgtttcaaaactatgaagcgcttcgtgccggccggcccgccgggggaagccagggcaaaccttactctgactatatcaaatggctcggaggccgggattatgaggaggcggaacaatattggagcagccgcctggcggatttcgaacagccgatcctgctcccgggccgtctggcatcagaaaagaaagactactaccaaaatgaagaatattcttttgtctgggatgaagagctggtcgcgcagattcagcagaccgccaaccggcatcaagtcacggggcctaacctgtttcaggccgtttggggtgcggtgctcagcaaatacaactatacagacgatgtggtgttcggcaccgtcgtatcaggccgtccttcagaaatcaacggcattgaaacgatggcggggctgttcatcaatacgattcccgtcagaatcaagattgacaaagatgcagccttttctgacgtgatggcggcagttcagaaaaacgccgtggaagccgagcgctatgattatgtgccgctctatgacattcaaaagcgctccgctctggacggcagcctcttgaatcatttggtcgcgtttgaaaactatccgctggacaaagagctggaaaacgggggcatggaggaaagactcggcttttccattaaagttgaacatgcttttgagcagacgagctttgatttcaatctcatcgtgtatccgggaaaaacgtggactgtcaaaatcaaatacaacggagcggctttcgctcatgatgccatcgaacgaacggcgcatcatctgacccgcatgatgaaagcggcggtcggaacgcctgatgcgcccgtgcgggaactcggccttgtttcaggcgaagaagagcggcagattgttgagatattcaatgatacaaaaacggcgcttccggaagaggaggccgttcaccgtttgtttgaagcacaggcaaaccggacgcctgcaagcatcgcgataaaagaagcgggacgcgaatggacctaccgtgaagtgaacgaagcggccaaccgcctggcgagacaccttgtgaagagcgggctggaaaaaggccggaccgccgctattatgaacgaccggtctgcggaaaccgttatcggaatgcttgccgtcctaaaagcaggcggcgcctatgtgccgattgatccggcttttccggaggaccgtctccgctttatggcggaagacagctcgattcggcttgtgctgacagttcaggactatcaagaacaagcgggcacattgcaagtcccgattgtcatgctggatgaaagcgaggatgaaacggtaagcggaacagacttgaatcttccggccggcggcaacgacttggcgtatatcatgtatacatccgggtcgaccggaaaaccgaaaggcgtcatgattgaacacagaaatatcatcaggctcgtcaaacattcgaattacgtgccggttcatgaagaagaccggatggcgcaaacgggagccgtcagctttgatgccggaaccttcgaagtcttcggcgcattgctgaacggagcggcattgcacccggtgaaaaaagagacgctgcttgacgccggacgcttcgcccaatttctgaaagagcagcggatcacgaccatgtggctgacgtctccgctgtttaatcagcttgcccaaaaggatgccggcatgtttaacacgctccggcacctcatcatcggcggtgacgcgcttgtgccgcatatcgtcagcaaagtgaggaaggcatcaccggagctgtcgctttggaacggctacgggccgacggagaatacgacgttttcgacgagttttctcattgatcaggactacgacggctcgatcccgatcgggaagccgatcggaaattccactgcgtacattatggacgaaaaccgcaacctccagccgatcggcgcgcccggtgagctgtgcgtcggcggaagcggagtggcaagaggctatgtgaatctgcctgaattaacggagaagcagtttgtccgcgatccgttcagaccggatgaaatgatataccggacgggggacttggcgaagtggcttccggacggcacgatcgagtttctcggcagaattgacaaccaagtaaaggtccgcggtttcagaatcgagctcggcgaaatcgaggcgaaaatcagccaggcggagaatgtgacggaatctgcggctgtgatccggaaaaataaagcggatgaaaatgaaatctgcgcttactttaccgcagaccgggacctttcaccggaagacctgcgcaaaacgctttcggaatcacttccggaatacatgattcccgcgcacttcatccagatgaatcagtttccgctgacggcgaacggaaagattgataaaaaagcgctgcctgagcctcaggctgaagccgttcaaaaagaatacgaagcgccgaaaacggaagcggagcagaaactcgcggacatttgggaaggcattctcggtgtaaaagcgggtgtgactgacaatttcttcacgattggcggacattctttaaaagctatgatgatgaccgctaaaatccaggagcactttcaaaaagaagtgccgattaaagtgttatttgaaaagccgaccattcaggagcttgcgcattatttggagcatgagagcgaggaggaacagcagtttgaaccgatccgacaagcgccttatcagaagcattatcctgtttcctcagcacagcgcaggatgtatatccttaatcagctcggacaggccagcacgagctacaacgtccctgctgtacttctgctggaaggatcagtagacaaaaagcgtcttgaagaggccatgcaggcattaatcaaccgtcatgagacactgcgtacgtcgtttgacatggcagatggaaaagtcgtgcagaccattcataaaaatgtgtcgtttgagcttgaaaccgccgagggccgggaagaagatgcagaagagctgacaaaagcctttatcaggccgtttgcgctcaatcatgcgccgctggtccgttcgaagctgatccggcttgaagaagaccggcatcttctgctgattgacatgcaccacattattacggacggaagctcaatgggcattttcatcggtgatcttgcgaagctttatcaaggcacggagcttgatctgccaaagattcattataaggatttttcagtctggcggcgtgaaaaagcaaatctcgatcagcacgaagcctactggcttgatacgttcaaaggcgatctgccggtgctggatctgccgcttgatttcccgcgtcctgccgagcgcagttttgaaggggaacgcgtcatcttcgggcttgataaacaggtgacggcgcagattaagaagctgctggctgatacggatacgacgatgtacatgttcttgttagccgcttttcaagtgctgctgtccaaatattcggggcaggaagacatcatagtcgggtctccggcggccggaagacagcatcctgatctccaagacgtgccgggcatgtttgtcaacaccgtggcgcttcggtcgcatcctgccggcaaaaaaacgttcaagcaatttctggatgaagtgaaaacggcgagccttcaagcttttgagcatcaaagctatccgcttgaagaattaattgaaaaactgccgttaacgagggacacaagccggagtccgctgttcagcgtgttatttaatatgcagaacatggagatcccggccctgcggctcggagatttggagatttcttcttactccatgcatcatcatgtcgctaaatttgatctttccttagaagcggctgagcgcggagaagaggtcggattgagctttgattacgcgaaagccttatttgcggacgaaaccatccgccgctggagcgctcattttgtcaatctgattaaagcctgcgccgaaaatccggaaattcagctggccgacgcaagcctgctgtccgctcctgagcgggaagcgctcctttctgatgaaaaacggacggaagcggatctgcctgagggcacttttgtttcgctgtttgaacggcaagcgcagaaaacgcctgatctcacggcggttgcgggcggaacaagtctgacatatcgtgagcttgatgaacgctcgaaccggtttgcccgacaccttcaggcttgcggaacgggcagtgaggacatcgtggccattatgatggatcgttcggccgacttgattaccgcgattctcggcgtcatgaaagccggagcggcatttctcccgattgatccggagactcctgaagagagaatccgctactctctcgaagacagcggaacgaagcttctggtcgtcaatgagagaaacatgaccgcggccgccgtttataaaggaaaaacggtcgtaatggaagacggagaatggcagaacgaaagcgccgaccggcttgaaacggagtccggcgccgaccggcttgcctatatcatttatacctcgggaacaacgggcaaaccgaaaggcgtccagctggagcaccgcaatctaatcaattatgttacatggttcagccgtgaagccggtttgaccgaagctgacaaatccgtgctgctgtcttcttacgcatttgatctcggctatacggccatattcccgattcttcaggcgggcggcgagctgcacattgtgccgaaagagacgtacaccgcacctgatcagcttggtgagtatatacagaaaaacggcattacgtatatgaaactgacgccgtcattgttccatatgatcgtcaacacagcccgttttacgtcagaacgccgtttcagcccgcttcgtttagtggtgctcggcggagaaaagatcatcacgtccgatgtccgcaagtttcatgacgtatacgcccataccgacttcatcaatcactacgggccgacggaaacgacgatcggcgccattgcggaacggatcaatatggagcgtcttgatcaatatgagcagcgtcccgtcattggccgcccgatcgcaaataccggcgcgcttgtattggacggagcaatgcagctcgttcctccgggcgcaagcggcgagctttatattaccgggaaggggcttgccagaggatatcttcaccgtccgcagctgacggcggagaaatttctctcaaatcctttttcaccggacagcctgatgtacaaaacgggagatgtcgtccgcaggcttcctgacgggacgattgaatttatcggccgtgcggatgatcaggtgaaaatccggggctaccgcattgaattaaaagaggttgaaaccgtgctgttaagcgtaaacggcattcaggaggcggtcgttctcgcagtcagcgaaggcgggctgccggaactgtgcgcgtactataaagccgacagtgggctgaaaggctctgagcttcgcaaacggctttccgaaacactgccgtctcatatgcttccggcttatttcgtgcaggtagaccgcattccgctcacagccaacggaaaaaccgataaaaacgccctcccgaaaccgggcgtcagccaaacggcgcaaacagcttcagccttgccggaaacggaattggaggaaaagctgtgccgcatttggaaacagacactcggtacggatacgctcggcatcgacgataatttcttcgattacggcgggcactctttaaaaggcatgatgctcctcgccaatattcaggctgaactggacaaaacggttccgttaaaagcgctgttcgaacagccgactgtccgcctgcttgccgcatatatcgaaaaatcggcggtatctgagggatatcggatgatcacaccggcagacagtgcagacgcgtacccgttatcatccgcccaaaaacggatgtacgtcctgaaccagcttgaccgggagacaatcagctataatatgccgtccgttcttctgatggaaggagaagtcaatatttcaaggcttcaggaagcgctcaatcagatgatcaatcgccacgaatctttgcggacgtcctttatcgatcaaaaaggccagccgatgcagaagatcgcagaacaggctgacattgacctgcacatttttgaagcagcggacgaggagaaagcggatcttatcattcaggcattcattaagccgtttgatctgagcgcggctccgctcattcgggccgctcttgtcagactgaatgaaaagaaacacctgctgctgctggatatgcatcatattattgccgacggcgtgtccagaagcatgctggtcaaagagctcgctcacctttacaaaggcggaagtctgccgtcgccgaacctgcactataaagacttcgccgtctggcagaatgaacccgggcaggccgaacggatgaaagaccatgagcgttattggctctccgcattttccggcgagcttcctgaattgaatctgccgaccgattttccccgtccgccggttcaaagttttaaaggacaatccgtccgtttcagagcggggcgtgaaacggaaaaagcggtgcgtgaattaatggaatcatcgggagcgactcttcatatggtgcttcacgccgcgttccatgtctttttgagcaaaatcacgggacagcgcgatatcattatcggctcggtgaccgccggaagaacgagcgccgaagttcaggaaatgccggggatgtttgtcaatacgcttgcgcttcgcaatgaaacgcgaaaagagcagaccttcgccgggctgctcgaacgggtgaaacaaaccaatctcgacgcgctggcgcatcaggattatccgtttgaggatctgatcggaaagcttgacctgccgagagatatgagccgcaacccgttgttccaggtgatggtgacgacagaagatccggataaagaaacactggaactggagaacctgcgcatcactccgtatgagtcaaaccaaggcacggcgaaattcgatctgacactcggcggctttacggatcaagaaggtctcggccttcagtttgaatatgcgactgatctgtttaaaaaagaaaccattgaaaagtggagcgccgggttcctgcggattctgaagcaagcggcggaaagcccggacagaaagctgcctgagatttcactgatcagcgatgctgaaaaacaagcccttcttgacgcatggaaaggaaaaacaatttctgtgccgcgggacaaaacggttcatcgtctctttgaagaaacggccgcccgctacgcgaaccggccggccgcggcatacaacggcgcgaaatggacgtacggcgagctgaacgcaagggcgaaccggatcgcgcgcattcttatggattgcggtgtcacggctgacgaacgtgtcggcattttaacgaaaccgtccttggaaatggccgcgggcgtactcggcgtcttaaaagcgggcgcggcatttgtgccgattgaccccgactacccggaagagcgcatcagctacattctgcaggacagcggcgccaagctgcttctcacacaggaagcgctggacgtgccggatggctacaaaggagaaacgattctgcttgacggcggacgctccattctgagcctgccgcttgatgaaaacgatgaagcgaacccgcagacggaaacaacggcggatcatctcgcttatatgatttacacgtcaggaacgaccggacagccgaagggtgtcatggtcgaacaccatgcgcttgtgaacctgtgcttctggcaccacgacgcattcgccatgacggcggatgataaaagcgccaaatacgcgggcttcggttttgacgcctccatctgggagatgttcccgacatggaccatcggcgcggagcttcacgtcattgacgaggcgatccggctggatatcacccgcttaaatcactatttcgaggagaacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggctatcaggtgcagccggaaggcattgccggtgaattgtgcgtggccggccgcggtctggcacgcggatacctgaaccgtgaagaagaaacggcgaagcggtttaccgcagatccgttcgtgcccggcgagcgcatgtaccggaccggcgacctcgtcaaatggaacgcgcagagcggcatcgaatacatcggccgtatcgaccagcaggtcaaagtgcggggctaccggatcgagctttcagaaatcgaagtccgcctcgcccagcttgcggacgttcatgacgcagcggtgacggctgtggaagacaaagcgggcaacaccgcgctttgcgcctatgtcgcgcctcggcaggacgatattgaagcgctcaaagccgcgctgaaagacacgctgcctgactacatggtgccggcgttctgggtggagatggacgagcttccggtcaccgcaaacggaaagattgacaaaaaagccctgccggaaccggacattgaagcgggaagcgccgcttacaaagcgccggaaacggagatggagacgctgctttctgacatttggcacgaagtgctcggtcttgatcagatcggcgtaagcgataatttcttcacgctcggcggcgactcgatcaaaggcattcaaatggcgagccgtctgaatcagcacggctacaagctggagatgaaagatctcttccagcatccgaccattgaagagctcgtctcttacgtggagcggacggaaggcaagcaggccgaccagggacctgtcgaaggcgaagcggacttaacgccgatccagcgctggttctttgagaaaaacttcaccgacaaacaccactggaaccaatccgtcatgcttcatgcgaaagacggctttgatccggacctggtggaaaaaaccctgcaagcattgattgaacaccatgatgcgctccgcatggtttaccgtgaagcaagggaaggcatcattcagacatacctccctgtcacagaatgcaaggcaagctttgaaatcgttgatctgtacggaacggacgaggatatgctgaaaagccagattcagcggcttgccgatcatcttcagggaagttttgatctggagaacggcccgctgttaaaagcggagcaataccggacagaacaaggcgatcatctgttaatcgcggttcaccatctcgtcgtggacggggtttcatggagaattctgttggaggatttcgcttcaggttataaacaggcgcagcagcaaaacagcatcgttctcccgcaaaaaacccactcctttaaagattgggcggaggcgctgaacacgtttgcgcaatcagaagagctgaaaaagcaggcggcttattgggcgcaggcagatgcggaagaactccggccgctgccgaaagaccatgatccggacaaacggctcgtcaaacatacggcggccgtgaaatgtgaattaactgaggaagaaacggcacagctgctgacagatgttcatcatccgtacggaacggaaatcaacgacattctgctcagcgcgctcggcttaacgatcggtgaatggacggaaaacggaaaagtcggcatcaacttagaaggacacggccgggaagaaatcataccgaatgtcaatatttcacggacggtcggctggtttacggcccaatatccgttgattctgcagatcagcaaggaagacggcgtctcttccgtcattaaaacggtaaaagagacagtgcggcgcgttcctgataaaggtgtaggatacgggattctccggtatctgtcatccgatgaaacagaaaaaggcgtcacgcctgaaatcagttttaactacttggggcagtttgacaatgaagtgaaaacggaatggtttgagccgtctccatatgatatgggacgtcaagtcagcgaagagtcagaggcgttatacgcactgagcttcagcgggatggttacaggcggccgcttcgtcatttcctgctcatacaatcaggaagaatatgaaagaagcaccgtcgaaacacagatgcagcggtttaaagacaatcttttaatgatcatccgccattgcacggccaaagaggagaaagaatttacgccgagcgatttcagcgcgcaggatcttgagatggatgaaatgggagacatctttgacatgcttgaggagaatttaacgtgacaaaaacagttaacagaaggggggagcggagcagatgagccagttcaaaaaagatcaagttcaggacatgtattatttgtcgccgatgcaggagggaatgctgtttcatactctcctgaatcccggccaaagcttttacatcgaacaaatgacaatgaaagtaaaaggcagcttgaatattaaatgccttgaagaaagcatgaatgtgatcatggaccggtacgatgtatttcgtaccgtgttcattcacgaaaaagtaaaaaggccggtccaagtcgtattgaaaaaacggcagtttcagatagaagaaatcgatctgacacacttaacgggcagcgagcaagcatccaaaattaatgaatacaaagaacaggataagatcaagggctttgatttgacgcgggatattccgatgcgggcggccatattcaaaaaagcggaagaaagctttgaatgggtgtggagctaccaccacatcattttggacggctggtgcttcggcatcgtcgtgcaggatctgtttaaggtgtacaatgccctgcgcgaacaaaagccgtacagcctgccgccggtcaaaccgtataaagactatatcaagtggcttgaaaagcaggataaacaagcatcactgcattactggcgcgggtacttagaagattttgaaggacaaacgacatttgcggagcaaagaaagaaacaaaaggacggctatgagccgaaagagctgctcttctcactgccggaggcggaaacaaaagcatttaccgagcttgcaaaatcgcagcataccactttgagtacggcgctgcaggcggtttggagtgtattaatcagccgctaccagcagtccggcgatttgatcttcggcacagtcgtttccgggcgtcccgcagaaatcaaaggcgttgaacatatggtcgggctgtttatcaatgctgtcccgaggcgggtgaagctgtctgaggataccacatttaacggcttgctcaagcagctgcaggagcaatcgctgcagtctgagcctcatcaatatgtgccgctctatgacatccaaagccaggccgatcagccaaagctgattgatcatattattgtgtttgaaaattatccgcttcaggatgcaaaaaaagaagagaacagtgaaaacggctttgatatggaggacgtccatgtttttgagaaatcgaattatgatctcaacctgatggcttctccaggtgatgagatgctgattaagcttgcctataacgggaatgtgtttgatgaggcgtttatcctgcgcttaaaatctcagcttctcacagcgattcagcagctcatccagaagccggatcaccctgtcaatacgatcagacttgttgatgaaaaggaaagagagcttctgcttaccggcttaaacccgccggctgagactcatcaggcgaagcctctgacggattggttcaaggaagcggtgaatgtaaatcctgatgcaccggcgcttacgtattccggccagactctttcctatcgcgaattagatgaggaagcgaaccgtcttgcgcaccgtttgcaaaagcaaggtgcgggtaaagacaccgttgtcgcgttgtacacgaagcgctcgcttgaactggtgatcggcattctcggcgtattaaaagcaggagcggcttatctgccggttgatccgaagctgccggaggaccgaatctcgtacatgctgactgacagtgcggcagcctgtctgctgacacatcaggagatgaaagaaaaagcggctcagctgccgtatacaggaacaacactcatcatcgatgatcaagcacggtttgaggaacaggcaagcgatcctgcagccgtaattgatcccgatgatccggcgtatattatgtatacgtccggcacaaccggaaagccgaagggcaatatcaccactcatgccaatatacaaggattggtcaagcatgtagactatatggcattttctgaacaagatacgttcttatctgtttcgaattacgcctttgacgcatttacttttgatttctacgcatcaatactgaatgcggcacggctcattatcgcagatgaacatacactgcttgatacagaacggctcactgatctgatccggcaggagaatgtcaatgtcatgtttgcgacaaccgcactttttaatcttctcaccgatgcgggagaggagtggctgaaggggctccgctgtgtgttattcgggggtgagcgcgcgtctgtgcctcacgtcagaaaggcgcttgagatcatggggcctggcaagctgattaattgctacgggccgactgagggaacggtgtttgcgacagctcacatcgtgcatgatataccggattccatttcctcattgccgatcggaaagccgatcagcaatgcaagtatttatattcttaacgggcaaaaccagcttcagccgttcggagctgtcggtgaactgtgcatcagcggaatgggtgtatcaaaagggtatctgaaccgtcacgacctgacgaagcaaacgtttatcccaaatccgttcaagccgggagaaacgctttaccgcacaggggatttagcacgctggctgccggatggaacaattgaatacgccgggcgtattgacgaccaggtcaaaatacgcggtcaccggattgaacttgaagaaatcgaaaagcagcttcaggaatacccgggtgtgaaagatgcggtcgttgttgcagaccgccatgagtccggagatgcatcaatcaacgcctatctcgtgaaccggacgccgctttcagctgaagacgtaaagaggcacttgaaaaaacagcttcctgcttacatggtgccgcaaacctttactttcttagaagagcttcctttaacgacaaacgggaaggtcaataaacggcagctgccgaaaccggatcaggctcaggcggcgaaagaatggatcgggcctcgaaacgcgacggaagaaacgattgcacacatctggtccgagattctcggcagacagcagatcgggattcatgatgatttcttcgcgctcggaggccattccttaaaagcgatgacggcagcgtcgcgcattaaaaaagagctcggtacggacatcccggtgcagctgttattcgaagcgacgacaatcgcagacattgccggttatctgcttcacggtgaagaaaaaggaatgaaagatctcaccatcatgaataaaaatcagtctgacacactgtttgcgttcccgccggttctcggttacgggctgatgtaccagccgctggcaaaacagctgtccggctatagaatctgtgcgtttgattttatcgaggaagacaaccgcatcgaacgctacacagagctgatcaatcagctccagccggaaggaccggtcaagctgttcggatactcggcaggctgcacgctcgcctttgaaacggccaaacggcttgaagccgaaggacgtaaagtggagcggctgatcatggttgattcttataaaaaacaaggcgtcagcgacttggaaggccgcaccgtagaaagcgatgtccaggcgctgatgaaggtaaaccgggataacgaagcgctgaatgacgaaaccgtcaaagaaggtctcgccaaaaaaacaaacgcgttttattcttatttcgtgcataccgtcagcaccggcacggtcaatgcggatatagatctattaacgtcagaaccggactttgcgatgccgccgtggctcgcttcgtgggaggaagccacgacaggtgaataccgtgtgaaaaaaggctgcggcagtcacgcagaaatgcttcagggagaatgtctcgaaaggaatgcggcatatttgctcgaattcctaaggaaggaacatccgaagctgacagcttcacgatagaaaaggaggaagcccgctaatggtccagctctttaaatcgttcgataccacagaaaaaacgcagctcatctgttttccgttcgcaggaggctattccgcatcattccgcccgctccacacctatcttcaaggtgagtgtgagatgctcgccgcggaaccgccgggacacggaacaaatcaaatgtcccccgttgaagattttgaacagcttgtcagcttgtacaagcaggagttgaatctccatcctgaccgcccgtttgtcctgttcggccacagtatgggaggcatggtcgctttcaggctggctcaaaagctggagcgggaggggatttacccgcaggccgtgatcatctcagccattcagccgccgcatattgaaaggaaaaaagtgtctcatcttgatgatgaaaaatttctcgcccatattatcgagctgggcggaatgccgcaggagttagtggagaataaggaggtcatgtcatttttcctgccttctttcagatccgactaccgcgcgcttgaaagcttccgtccgtctgattctcacatgattcaatcacccgtccatatttttaacgggcggaaagataaaaaatgtatcaaagatgcggacggatggaaaaaatgggccgacaatcccgtatttcatgagttttcggacggccacatgttcatattaagtgaaactgaaaaagtggcggaacgaatatatgagattattaacaggagcactgcaggccaattgttataggagatgacagacagcattcgctgtctgttttttgtaacaaaatctgcccgtgagttttctcatttatcaaaaattttatgttatgatttgatggaatataattttgaagggattgtcgtacatgaatgatgcagcaaaagagctgaacagaacattatctgaagaaaacccgcacgtgcttcatatgctttctgatttgggcagagagttgttttatccgaaaggggtgctgacacaatcggcggaagcgaaagccaaggccggaaagtataatgccacgatcgggattgccacctcacaaggcgagtccatgcacttttcccatattcaagagacattgtccgcctataaccccgatgatatctacgattatgctccgccgcagggaaaagagccgctcagacaggaatggctgaaaaaaatgcgtctcgaaaatccttcattagccggcaaagatatcagcacgccgatcgtgacaaacgctttaacacacgggctgagcattgccgccgacttgttcgtcaatgaaggggatgcgctgcttctgcctgataaatattggggaaattacaatttcattttcggtgtccggcgcaaggcatccattgagacgtacccgctttttcagcaggatgggcgttttaatgcggcggggctgtccgagctgctgaaaaagcaggaagaaaaggcgattgtcgtgctgaatttcccgaataatccgacaggctatacgccgggagaagaggaagcggcagaaatcgtcagcgtgatcctggaggcggcggaggccggcaaagagattgtcgtgctcgtagacgatgcgtattacaatctgttttacgatgaaacagccattcaggaatccatcttcagcaaactcgcccaagtgcacgaccgggtgctttgcgtgaaaatagacggcgcgacgaaggaaaattacgcgtggggcttccgcgtcggttttattacgtacagcacaaaaagcgaaaaagcgctgcgcgtgctcgaggaaaaaacaaaagggattatcaggggaacgatttcaagcgccccgcatccgtcccaaacgtttatgctgcgggcgatgcagtcaccggaatacgagaaagaaaaatcgctgaaatataacatcatgaaaaaacgggctgacaaagtgaaagccgttcttgcagaaaacaagcactatgaagacgtatggacaccttatccgtttaactcgggttatttcatgtgtgtccggctgaaagacataaacgccggcgaattgagagtgtcgttgcttgaaaagagaggaatcgggacgatatccattaatgaaaccgatttgcgaatcgcattttcatgtgttgaagaagaacacatcgcggatctgttcgaagaaatttatcaagaagcaaagcagctgcagaaacaggcggaaatatcaagctgacaaaaaaggagggggagaccctcctttttctatgcttacagcagctcttcatacgttttcatcgcaatcccgtcacaaaaatcgggatgcgccgcacaaacggccagcttatattcctcgtccgcatcatatgtgcggatgaaacatggttcatgtccgtccgggagctcaatggacacatggccgtcgtctttgaggcggacgctgaatgaatcaagcggcagggaaagcccttttccggcctgcttgataaagctttctttcatcgaccacaggtggtaaaaataatcggtctgctgatcggggtgtttcgcttgcagatcactgtattccgtcggcgaaaaaaaacgtttggcgatatcaatcgtgccgggcttcattttttcaatatcaatgccgatcggttttgaatcaacggcacacacgatccagcgcccggagtgggaaatattaaagtgcatgtccggaagcgcgggtatgtacggctttccgtattcctggacgctgaatgaaatcgcggccggatcaagtccgtaagctttcgccgcagcggtgcggatcagcatgtcgccgatcaaggtgcggtgagcatcctccttatggtaaaagcgccggcatttttcccgcttttcagcggacacggccgtcatcatccgatcctcttcccctgcagaaagcgggcggtccatatatactccgtaaatcttcatgtccagatcctccgtctgaaaatattgtcaaaaccatcctatcatatcaaacgaaagctgtccgaaaataaaaaaacaaaaccgtttcggctttgtttttaatgcacggacgttgcccgcccggagatcgcgtatgttaacagtttagaggactgcggcaaagaaaaacgcagaatcagccccgtcaaaacagccgtaataatggttccggcgccgatcggtccgcccatcacccaggctgcggcaagaatcgtcagctcaatgccgttccgcacccattgcacgttccagcccgttttttcagatatcagcatcatcagagagtcccgggggcccgcgccgagcccagccgatacgtaaataccgacgccgcagccgatcagcagcaatccgatagaaaaaaacacggccgctaaggaaaaagcgtgcgcctcaggaagcagaaacgagaagaaatcaataaacattcccatcagcaccatgtttaagatagcgccgattttcgggagtgtcctcgtgaacaggcaggttaaagccacgatgaccgcgccgaccaagatggaccattggccgacagatagcccgaaatgctgaaaaagcccataatgaaaggcatcccaagggctgatgccgagagcttttcctttaatggttaacgataccccgaaagacaaaatcaacagaccggcaaaataaaacgtccagcgcatcaagaattcccgcttcaaagaggtcccttctttcataaaatttcattaattgtcattgtagcataaccgccaaaaaaaagaagaagcgaaatcagtgtttcgcttcttctccggctcctacaaaggattcagtatacggtttaaaaaccgctgcgtgcgttcttctttcggcgcggaaaaaatctgggccggcggtccttgttccacaatgacgccgccgtcaatgaagatgacttcatcagccacttcctgcgcgaatttgatttcatgggtgacgacgaccatcgtccagccttcgttcgccaaatccttaatcactttgagcacctcgccgaccagctccggatcaagtgctgacgtcggttcgtcaaacagcatcagctcgggctgaatcgcaagcgcgcgggcgatgccgacccgctgctgctgaccgccggaaagctggaacggatataaatccattttgtctttcagtccgactttttccagaagctccatcgcttcttttctgacttgctccttgtcgcgcttttgcacttgaacgggtccttccatgacgttttcaagcgccgtgcggtgaggaaacagatgatacgcctggaagaccatgcctgatttgcggcggaggcggagaatatcagcctgcttcacttttttagagaaatctattgaaaaatcggagaatgccagctcgccgcgattggggatctcaagcgcgttcagacagcgcagaagcgtcgtttttccagaaccggacggtcccagaatggcgatgactttccctttttctatctccatatctatcttttttaaaatttcattctgtccgaatgatttatttaatcctttgacggaaagcatatcgaaacctccttatttggccacataacggtcgagacgccgttcgatcacatgctgtacgattgacagcaagaagcagatgatccaataaataaaggcggcttcaatatagatgaccaagatttgatcaaggttttgcgcgccgatttcctgcgcttttctgaacagctccgcgacgagaatctgtgacgcgagagatgtatccttgatcaggctgataaatgtatttgataatggcggaatggacacgcgaaacgcctgcggcaggatcacgcggaacaatgtcttgcgataggtcatgccgatcgtataaccggcttcccattgccctttcggcacggatgaaatagatgcccggatgatttcagaagcataggcgcccacgtttaatgaaaacgcgatgactgcgcttgggaaagggtccagcgtaatattaaatgtcgggaacagataaaaaatgatgaacaattgaacgagaagaggagtgccgcgcaccgctgatacgtatacgctgaacacccatctcaatggtttcatatttgacattctggcgagcgccgtaatcagcgcgatgatcattccgaaaataaaggaaagaatggtaaggggaatcgaataatagattcccccggaaagaatcggccagaatgactgctgcaccaaatcccacggaatggctgttgcaatcacgggctccggcatgttacttagaaacatcttcgccgaaccattttttagctattttagaaagagtcccgtcctctttcatttcttttaacgctttgttgacgtgagtcacaagttcgccgcttccttttcggaatgcgaaatacgtctgctgcggctggcctgcttcaaacgcgattttcacgtttttattgccggacgtttttaagtagttcagtacggcaagcttatcgttgtaagtcagatcagcgcggccctgctgaatgagctgaagggattgcgccatgccttcaacgccttcaattttcgcgccggcttctttcgctaatttattgtaattgcttgttaatgactgagccgctgtttttcctttgacatcagcctctttcgcaatcgtgctgtcttttttcgtcacgacgactgcatttgacgttgtgtatttatcagaaaaatcatattggttctcacggcctgttttgccgacttggttggcgacgacgtcaaaccgtttcgcgtttaaaccggcaaacatgctgtcccattgtgtttctttaaagtcagctttcagaccgaggcgtttcgcgacttcttgaatcacttcaacatcatatccggtcagtttgtcagtctttttatcatggaaggtaaacggttcgtacgttccttctgtaccgacggtcagtacgccttttttcttgacagaagcccaaagatcgccgtcttttgacttagatccgctgtcctgtgagtttccgcaggctgcaagcattgcgatgctgaccatcatgaacaaagcgaataatgcttttttcatcttctttattccccacttttctgagtagttttattgagaaaaaatagctcccaattgtaaaggataacttttttttagtatgagtcaagtaattggttttcataagcgggaattcatcgtgttccggatcaaaataattccaaaaactgtctgacaggcttcggcaggtagctgtcttttctccagatgacggccggtgtcatgacaaacgggttgtcttcgatgataaccgttttgacatgtgagcgcatatggacgggaatcatcgtcaaaggcagaatcgtggcaccgaatcctgatgatacgaggctcaagagcgtcgcggagtcatggcattcacaaacaacctggagatcgagactgtactgttcacaaacatggaggacttggtcatacacacctcttccattgacggtgcgcaaaaggatcagaggcaaagaggcgatgtcactcagtttaatcgtttctccgcacagtcgttttgaatgctcggacagcaccaatacacacggaatgtcttcaagctccttcgattcaatgccgtcgtttttaatcaaggtggtggtgacggcggcgtcaatctgccgggtttccagaagctcgagcagtgagacgggctcatcttcccaaatgttaaaggtgagatgcggaaaccgctctttcatctgtgacactttctcaagcatgagcgctgcgcagtaaatggttgacccgacggcaagtgtcccggccacctcctccttcagctcttgtacctcgattatagcgtcctcaaacttatgaagaatctctttcgctcttttcaaaaagacatttccttcatatgtgagggtcatttgtttctttttattgcggtcaaacagaatgacgcccaattcttcttcgagctgtttcaactgtcggctcaaaggcggctgtgccatatgaagctttttggcggccgtcgtgattttctgctcttgggcaatggtgatgaaataacgcaattgccgaatatccatgagaatgcgcgctcctttcttttatacctttaaggtatgatacatagatttaacgaatatttttcatatggatatatcaggagtatgatggatttgacaccacatttcaagcgtaaaggaggggtcaatatgaagctcgtcatcggaatgaccggggcaacgggagccatattcgggatcaggcttttagaatatttaaaagccgcggagatcgaaacccatcttgtcgtttctccttgggcaaatgtcaccattacacatgaaaccgattatacgttaaaagatgtcgagaaactcgcatcctatacgtattctcacaaagaccaggcagcggcgatttcaagcggctcgtttgaaacggacgggatgatcatcgctccgtgcagtatgaaatcactggcaagcatccgcaccggaatggctgacaatctgctgacaagggcggctgacgtcatcctgaaggagcggaaaaaacttgtgctgctgacaagagaaacgccgctcagccaaatccatttagaaaatatgctagcgcttacaaaaatgggttccgtcattcttccgccgatgccggcattctataacaagccggctgacatggatgaattgatagaccatattgtgttccggacgctcgatcagttcggcatccgtctgccggaagcgaaacggtggtacggaattgaaaaacaaaaaggaggaatctgataatggcctatcaggattttagggaatttctcgccgctcttgaaaaagaagggcagctcttaaccgtcaacgaagaggtaaaaccggagccggacctgggcgccgccgcgcgtgcagccagcaatctcggggataaaacccctgcgcttttgtttaacaatatttacggacatcacgatgcgcaggtggctctgaatgtcatcggctcgtggccgaatcacgcgatgatgctcggcatgccgaaagatacgcctgtaaaagaacaattctttgagtttgccaaacggtacgatgcatttccggtgccggtcaaacgggaagaaaccgcgccgtttcatgaaaatgaaataacggaagatatcaatctttttgacatccttccgctattcagaatcaaccagggggacggcggctactatttggataaagcgtgcgtcatttcccgcgatcttgaagatccggacaatttcggcaagcagaatgtcggcatttacagaatgcaggtaaagggaaaagaccgcctcggcattcagcccgtgcctcagcatgatattgcgattcatcttcgccaagctgaagaacgcggcgtgaatcttcccgttacgatcgcgctcggctgtgagccggtgattacgacggctgcatcaactccgctgttatacgatcaatccgagtatgaaatggccggcgcgattcaaggggagccctacagaatcgttaaatctaaattgtctgatttagacatcccttggggcgctgaagtcgttctggaaggagagatccttgcgggagaacgggaatacgaaggacctttcggtgagttcacgggccattattcaggcggccgcagcatgccggtcatcaaaatcaaacgggtatatcatagaaacaatccgatttttgaacatttatacttaggcatgccgtggacggagtgcgactatatgatcggcattaatacgtgcgtgccgctttaccagcagctgaaggaagcctatccgaacgaaatcgtcgccgtgaatgcgatgtatacgcacgggctgatcgccattatttccacgaaaacgcgctacggcggatttgccaaggcggtcggcatgcgcgccctgacgacgccgcacggactcggctactgcaaaatggtcattgtcgtggatgaggatgtcgatccgtttaacctgccgcaagtcatgtgggcgctctcaacgaaaatgcatccgaaacacgatgcagtcatcattcctgatctgtccgtccttccgcttgacccggggtctgatccggcagggatgacacacaaaatgattcttgacgccacgacgcctgtcgcgccggaaacaagaggccattattcgcagccgcttgattccccgctgacaacgaaagagtgggaacaaaaactgatggacttaatgaatcaataagaaaggatgaggttactatgaaaacatgcccgcgctgtgaatcgaaaaaaggagaaaccgtcagccaatcgccggtcaaaggcgcttgggaaatataccaatgccaaacctgctttttcacatggagatcctgtgaaccggaaagcatcacgaatccggcggcattcaacccggcatttaaaatcgatccgaaagaaacagagacggccacacatgttcccgctgtcccggaaagaaaagcgtaatgctgacggagcacttgccggaggcgctttacacgcttttagacggaacggagcttgaaaaaaagcagcacgacgcatttgtgctccaatccgtgacaaaagaaggccgtccgcacgcggccatgatcagcgccggtgaaatcgcggccgtgagcagaacaaatctccggctcgccttatggaaaaacacgacgaccgtaaaaagccttctgcattcgggacaagctcttttcatcgcctggcacggaggagccgcatattacgtcacattggaatgtaaggcgcttccgccgctgaaagaggcgaaacacgagcgggaacggttcagctgccgcgtgatcaccgtcaaggaagatcgggcgaaatacgcggatctgacatccggaccggccattcagctccacgaaccggaagttgtcctgaaaagatggagagaaacacttgaggagttaaaacgatagacgcacaaaaaaagcctgcggacgattccgcaggcttttcttttattgtacgcctttcatcgcccgtttaatgacgggagacagaagaattaaaataataccgagaatgatcgaaacaagaccgattgagccgaagtaggccgcttcagaaatcttatcaaacaaaccgactacttttgcgttcagggcttgaccgcaggcgtttgttaaaaaccacatactcatcgtctgcgctgagaaagctgcaggcgcaagtttcgttgtgacggataaaccgaccggtgaaaggcaaagctcaccaagcacaaccaaaaggaagctgagcacaagccaaagcgggctcacaagctccccgcttccgcccataaccggaagcaccatgactaaaaatgataatccggcaaggataatgccgatcgcgaatttaatcggtgttgaaggctggcgtttgccgagcttcatccagatccatgcgaacaccggcgcgaaaataacgatgaataacgggttcagagactggaaccatgaagactcaagatgcatgcccgcaaaggaaagtctcgtgcgctgatccgcatataaagcaagaatcgtcgcgccctgctcctgaatcgcccagaacattgccgctgcaataaacagcggaacataagccgcaagccgtgatttttccgttttcgtcgcttttttgcttgtgaacatcacgataaagtaaataaccggaatgacaatgccgaggatactgacggtgtcaatcacacgctggatcgtcagccagccggtttgaatcagaacgataataacggctgctgcgatgaccactccgattcccgtgccgatcactgatgatttagaaatcggattcggtacattggagcctgctttgccgaggtatttctttctcgtaagagcgaaaacaatcagtccgaggaacataccggccgcggcgcatccgaagcctaagtggtagttgtacttctgtccgagtgttccgacaattagcggcgcaagcaatccgccgaggttgatccccatgtaaaagatgctgaaacctgagtcgcggcgctcgtcttccttcgtatataaatctccgacaacgctggatacgtttggtttaagcaggccggttccgataatgatcagagccatgctggtaaaaaacgccgccgtgctgccggggaaggcaagagcgatgtgcccgaacataattaaaattccgccgtaaaatacggtgtttgccgtgccgaatacccggtcggccagccatccgccgatgacgctcgacatatatacgagagatccgtatatggacatgatggcaactgcggtcgttttatcaaagccgagaccgccatgagcgacttccgtgtataaatagtaaagcaatatggctctcataccatagtaggagaaacgctcccaaaattcggtgaaaaacagtgtgaacaagccgcggggatgaccgaaaaagcctcgttgcggcacagtttctgttatagattccttatcaatagatgccacctgagccaaccctttcttaaaaaagtgtattacaaaaatcatattcttatataatacttgtgtcaatataatttatactgaattcaaaaaattccagaatgaaaagatattaaaacgtttaatatagacgaattttcctgattccaatgacttattttgttatattatctgactaaactatctttataaacttttttaataaaatttaaagtatgtacaggcggagcgggatatggcggaataagatgacaataagagaggaaggaggagattatcacttgccgaatcgtatattggatattacggattgcggtgtggcggcggacggaaaaaccgatgtgacgggcgccatcaaccaatgcttggccagggccgtcagcgaaggctgtcatacggtgttttttccgcccggaacgtataaaatcaacggcacgcttggcggggacagaagtcagccgtttcggaacgccgggattaacgtgccgagccatctcaccatcgttttagatccggaatgcacgattaaagtggcgccgaacagctcctggggctactcggctttctatataggcaggcgtgaaaatgtcaccatcaccggcggccggatcatcggggaacgggatgaacacacgtataccaatgtccctttgcggtcgacccatgaatgggggtttggaatctgtattgaaggcagcagcaatgtgctgatcgaaaatgtgaagatttcggattttacgggagacggcataattgtcagcccgctcgggttaaaaacaaacagtgattacgaaacttcagaacaggtgaccatccgccgctgtgagatcaggcagtcaaggcggaacaacatttcaatcaccggctgcaataccgttacggtggaagaatgcgtgattgaagacgccgggcaagggaacggaacggctccgaaattcggaatcgatattgaatcgtacggagaaggcgatattgattatgaagaagctcttcatattacggtccgcaacaacttcttttccggaaacgccgcaagctcagtcaccaattttaacggatataatgtgttaattgaaggaaatcattccgataacacaatcagctacgggtacggggcacataccgtcatttcggggaatgtcttctttcggtcagacggcggctcaaggaccgcagtcgccggacaaggtgtgtcacaaggacaggacagcagcaatgccgtcatttccaacaatctgattaccgggttttccaccggaatagatgtaaggggaaaaagcgtcctcgtcacccacaacaaaatcaatcaatttgaaaatacgggcatttccgtctatcaggcagaagatgtgaccgttgacggcaatgtcattaaaaacggacgttccgaaacgagacgaagcacggggatgcgggcgacgctgtcggagaacgccgtctttacgaataacactctgaatcaggtgacagacggaatcagcatgtcggccggcagtatcattgtaaaacaaaatgtgctgacatcgttcagccggggcatatgggtcacaggcggaaatgccgttattgaaggaaatacgctccttccgaatgcgtatcagggcgccgcggagtcctatgccgtatctgtgacaaatgacgccagggctgtcatcaaaggcaatctctttaagaactataaaaactatcccgtattcagttcaacatcctcgggaacctctgtcatcagcaaccgctttgaatcatcaccgcttatcgttaccgtgtatctgaactcaggcacgcatgaagtcatagacaatacgctcacgatcaaccgaacagcgggcagcccgatcggcatctatctgaacggagcctccaattccctcgtttcgggcaataccatcaacaacctttccgccgcttctgcttccgccatccaaaccagctcctccgcaagtactaaaatcatcggcaaccgcattatcaaaggcgtcattgtgaaacacgcgacagatacggaaagcggaaatatcgtcatctgagaacaatctgcgccggaaaaataaaaagaacacatgaactccgagagaaggagggatgtgttcttttttgacacaatacagccgtgcgcctgtcaggcatcttttttacctgatttatataaagcgatcatttctctgattaaaaagagggcgaataaaaacagcatcagccattctgagaaggtggtcaatttaaaagcggacaggttgttttggaccgctccatagaaactgaaaccttgcagcatatccatcgttactgaaatgatcagacaggcagtcagcaaaaaaaatgaaacccccaatattttcatgcgcatcactctccctttttatccttttcgattacgcagaacttatgcaggctttccgccgtgcataatcttttgccgtacaggaagaatatgaaaaaaacgaggaaaggttttttgcgatatgccgccattttttaagcagaggaaacaaaaaaaagccgatcaaaacgaccgtgacaatgaaggcagaaaagaagcggacagccagccggacaaagagcgggatgagccgatctccctcagcttaaagcaaaatatgaagaagctgtctgagaggttcggcaacagtgccgatgtcgtcatccgccggctgaaaatcggaaaagaagagcttccggccgcaattgtgtatatcgccggtttggtagacgaacagcttgtcagccaatcccttctggaggatttaatcgacatcccgtccgttcagccggaacaagcggtctgcctgatatacgataaaacgcttgcgatcggcggggtgaaagaggaagaaaaatggaaaagcctttatgccgggctggtggcgggcagcacgctcatttttgtcgacggtgctgacaaggcgctgatcgccagcacggaagggggcgagcaccggtccattcaagagccgagcactcaggtctctttccgcggcccgcggcagggattcactgaatctctgcaaaccaatatttccatgatccgcaggtatgtaaaaacgcctgatgtatgggttgaaaaaatggagatcggacacgaaacgaatacggatgtcgcgctgatgtatattaacggaatttgcgataaaaagctgattaaggaagtccgcaagcggctgaagcacattgacatcgacagcattctggaatccggctacattgaacagctcattgaagacgcgccgttttctgtgttccccaccgtatatcatacggagcggccggacgtcgtggcggggaatctgctggaaggacgatttgcgattatcgtggacggaacgccgttcgttctcatcgcgccggccttatttattcaattttttcaatccgttgaggattattattcacgatttgatatcgccacaagcatcagggtgctgcgggttttgattttcttcatttcactggtggcgccggggatttatgtggcggcgacgacctttcaccaggaaatgattccgacgcagctgctgattgtcatcgcggctcagcgggagacggtgccgttcccggccgtgattgaagcgctgacgatggaagtggcctttgagattctcagggaggcgggtgtccggcttccgagagttgtcggctccgccgtttccatagtcggagcgcttgtcatcggccaggccgccgtacaggccggcatcgtctccccggccatggttatcgtcgtcgcgctgacggcgattgccagctttgcgaccccggcttttgacatggcgatatccgcgcggctgatccggtttctctttattctgtcagcggcggtcatgggattttacgggctgattctgggcattatcatgatgttcgtccatctgtgcggcctgcgttcattcggttttccgtatatgtccccgctcgctcctttgaccccgggcgggctgaaggattccatcctccgcgctccgttatgggcggatgaaaaaaggccggaactgctcgtgcaggaaaacaacaggcgcgaaggggaacatcaaagaccgaaaccggagacatccagaggaatggttaataaagatgtagaagagggcgacggtaatgaaaagacgtaaatggatgcttatcctttgtacgatggtttcccttatgtttgtatccggatgctgggataaaagggagctgactgatttggctgtgatctccgccatcggtattgaccggaccgaaacgggaaaatacgtccttcacttgcaaattatcaatccgggaaacgtggccggcggtctgcagggcggcggagcgggagaccggcctccggtttccgtctattcggtgtccggagacaatatgacggaagctttgagaaaaggctcgatgaaagtgtccagaaggctctattttgcgcatacgaatctcgtggtgttcagtgaaaaactggcgaaagaggaagggctcagttttattctggacaatcttgaccgcgacaccgaattcaggacgaccgcaaccgcggttatcgcgcataattgcaaggctgaagacattattaaagtgctgacgccgattgataaaatcccttccaataaagtgaacaagacgctcagcttcacgcaggaacaatacggcagagtcattaaaaccagccttcaggacgttctgattgatctcgcttctccgaccgggtcgccgtttataccgggttatgaaatgcacggagacgaaaaagccggccctacaatggaaaatacgcagacgactgaaccgaaagcagtgctgtcagcggacggattggcggtgttcaaaaaggatgggaggctggattactggattgaggatgacgacagtgtgggggctgtatggctgctcaataggatcaagcatacgttcatcaatgcggattggaagaacgtgaagcatgcaatcagtctgcaggtcacccgccagaatacaaaggtgacggccacttttccgaacggaaaaccgcatattcacgtgcatgctcaggtcgaggggctggtggacgctgtcagataccctttccatctgtctgatccgcaagtgctgatgacgatgcaaaaggcgctcagcgtgcagcttgacaaagatatcaccaaatcaattgaagatataaaagcccgtaagaatgacttcgtcggcttcggagacctgatctatcggaagcatccggacaaatggaaaaagttcaaagggaagtgggaggaagaatatttccccaatctccccgtagatgtcaaaacggaagtcattatcagaagaacgggcttgcggaataatcctctctcagacaagcttgagcatgattgatgtgaggggaaaggagcgaagcgtatggaaaatgcgaaaatcggcacgcgtcagctgtttattatgatcattttgtttgaattgggcagttcgttattgatcccgccgggcacgatggccgggcgggatgcgtggctgtccgtgcttctcgggtgcgttaccggtctcggacttttctacgtttatcaggccctgtatcaattttttcctgagtcttcaccgagagattacatgaacgaactgatcggcagacatctgagctgggcggtctcgcttctttatattctctatttttcttatatcgcggcccgcgtattgcgggattttggcgaaatgcttgtcaccttcgcctaccaggacacgccgcttttaattgtgaatgccatgctgatgatcgccgcgatatttgcggtcagaaagggaattgaagtgatagcgagggccggcgagctgctgtttggcattatgtattttctgacagccgtcgggctgatcctcattatcagctcaggcacgatcaacctcagatttctccagcccgttttagctgagggtgcaggaacggtcatttattccgtgtttaaacagacgatgttcatcccattcggtgaattaatcgtgtttgtcatgattttcccttatttaaaagatcggaaaaaggtgaagaaaaccggatttctggcgattatcatcagcgggctgtttttggcgatgtcagtggcgattaatatttgtgtgctggacgtcaacttaatgctccgctctcaatttccgctgctgagcactatacagacgattaaagtagaagagtttttagaccggctggatgtctttttcatgctcgtgcttgtcatcggcggttttttcaaagtcagcctttttacatatgcggttgtcgtgggcgtgtccacgctgtttaaagaaaaaaacccgtcccagctggcctttccagtcggattgggggtgctgattctctccatcagcatcgcaagcaatttttcggaacacatgaatgaaggcttaaacattgtgccgatctatattcatcttccgtttcaagtgctgttccccgttttgctgcttatcattgctgttattaagaaaaaggtcaaagggaccgtctatacagtttcgaagaaataacccggccggtgcgccgggttattttaaaaatcatgatttttgtcttaatgcattgacaaacttgcgtgacaattgtacattttgatttattcttataaaattactaggaaatataggtttagtggtgttaatattttctgaaccgtatttcagaatagaaggagatccatcatgacaaagaaaaaagaaatcaaactcggtgtgtttctcgcgggcaccggccatcatgtcgcttcttggagacatcctcaggcaccggcggacgcgagcatgaatttggattatttcaaagaactggcgaaaacggctgagcgggggaaattggacatgctgtttttggcggacagtttatcaatagacggcaaatcacatccgaatgtgctgacgcgctttgagccgtttacgctgctgtcggcgctcgctcaggtcacatcccgcatcggtctggcggcgaccgcgtctaccacatacagcgaaccgttccatatcgcgagacaatttgcatcgcttgatcatctttccaacggccgcgcgggctggaatgtcgtcacatcttcgattgaatcgaccgcgcttaatttcagcggcgaaaagcatcttgagcaccatctcagatatcagcgcgcggaagaattcgtggaagtcgtcaaaggattatgggattcgtgggaggaagacgcctttatccgtgacaaagagtcaggagcatttttcgataaagacaaaatgcatgaattgaaccataaaggaacatatttctccgtgagagggccgttaaatgtcgcccgcacacctcaagggcgcccggtcattattcaggccggatcatcaggagacggaaaagcgctggccgccaaaacggcggaggtcattttcaccgcgcaaaatcatttggagtccgcgcaggaattctatcaatctattaaagaacaagcggcttctttcggccgtgatcctgaaaaaatcgcgatcatgccggggatctttcccgttatcgccgataccgaagaagaagcgcaggcaaaatatgaagagctccaagacctcatcattccgtctgtcggcctgaacattctgcaaaactatctgggcggcgtcgacctttccgcctgcccgcttgacggcccgctgcctgaattggatgcggatgcgtcgaatgccgttaaaagccggttcaagctcgttcaggagatggccaaacgcgataacatgaccatccgcgagctgtacaaatatgtggcggggtcaagaggccatcatatctttgtcggaacgcctgaacagcttgccgataagatggaagaatgggtcggaaaacaagcttgtgacggtttcaacatcatgccgccgcttttgcctgaaggtctcactctttttgtagacaaagtgattccgattttacaagaacggggcgtgttcagaaaagagtatgaaggaacgacgctcagagaacatttcggactggaaaaaccggcaaaccgatatgccgactaaaggagggctcatcatgtcaagacaataccggctcgcaacggaggcagacgctgatgagctgctttcactgacactgagggcgtatgaaccgatccgcaagctcggcatcaattttgccgctgccacggcggataaagaactcgtattaactaacatacaaaaaaacgcctgttacgttttggaggaagacggacggattctggcgacgatttctctgcggatgccgtgggggccgaatcccgggccgtacggtgtccctcatatttggtggttcgccgtcgatcctgaaaccggtaaaaaagggacgggctcagacatgctggcgtggctggagaacacagtgctccgcgatacattaaaagcgcctttcgtgtcactgggcacagcggacaagcatccgtggctgatcggcatgtacgagcggaaaggctacgtccgcgcaggcgaaaaggatttaggaaaagggcacatcaccatctatttaaaaaaacaattgcaggattaacattttaataggaaaaggcgggatttcaatgaagaagaaaacatgggctttgctgctgtctgccgcgcttttggcggtcttaacagcatgcggaaacggaaaagaaagcgaaggcggcgataacgtgctgcatgtcggcgccacgggacaaagctatccgttcgcatataaagaaaacggcaagctgacaggctttgacgtggatgtcatggaagccgttgcgaaaaaaatcaacatgaaactggactggaagctgcttgaattcagcggactgatgggcgagctccagaccggcaaactcgacaccatttcaaaccaggtcgctgtcacggacgaacgcaagaaaacgtataacttcacagaaccgtattcgtatgcgggcactcaaatcgtcgtcaaaaacgataacaaagacatcaaatcagtcaatgatctgaaaggaaaaacagtggcggccgttctgggctcaaaccacgcgaaaaaccttgagagcaaggacccggataaaaaaatcaacataaaaacatatgaaacacaagaaggtacgctgaaagacgtggcttacggacgggttgacgcttatgtaaacagccgcagcgtcctgatcgcccagatcaaaaagaccggtctgcctctgaaattagcaggagacccgattgtttatgaaaaagtcgctttcccgtttgcgaaagatgcggctcacgataaaatccgcaaaaaagtaaacaaagccattgaagacctgcggaaagacggcacgctgaaaaagctgtctgaaaagtactttaacgaagatatcacaaaggaagcaaagcaataagaaacggcggtgaaaatcgagaatgaacagcattgattggggatttatgttttcagcttttcccgcgttaatcgaagccttgccgatcacattactaatggccgtcgcggccatggtatttgccgtgatcggcggccttatattagcgcttatcacaaaaaatcgtattcctgtgcttcaccagctgtcaaaggtgtatatttcatttttccggggcgtgccgacgctcgtgcagcttttcttaatttattacggcctgcctcagctctttcccgggatgagcaagatgacggcgttaactgcggcgattatcgggttaagcctgaaaaatgccgcctacctggctgaaatcttccgcgctgcgctcaactcagtcgatgaggggcagcttgaagcctgtctgtctgtcgggatgacaaaatcccaggcgtacagacggatcattttcccgcaagccgtcagaaacgcgcttcccgcgacgggaaatacgtttatcggcctgttaaaagaaacatcgctcgcttttacattaggtgtgatggagatgttcgcccaaggaaaaatgtacgcatcaggcaacctcaaatattttgagacgtatttagccgtcgcggtcatgtactggattcttacgattatttacagtgtgctgcaggatctgctcgaacgggcgatcagcaagccttatcgcacataggaggaggctcaggatgatacaagtcagacatattcgaaaagcatttaaagaccttaccgtacttgacgggatcgatcttgagatcaaaagcggcgaagtcacggccatcatcggcccgtcaggctcgggaaaatcaacgctcctccgctgtctgaatctgctggagcgcccggatgacggcatcattgaaatcggcgatgcaaagctgaatgcagcgtcctattcgcgcaaagacgtacacaagcttcgccagcagacggcgatggtgtttcagaattacaacctgttcaaaaacaaaaccgccctgcaaaatgtgacagaggcgctgatcaccgcgcaaaagaaaccgaaaaaagaagcggaacagatcggtatggacctgctgcggcaagtcggtttagaacacaaagcggacagctacccgattacgatgtcaggcgggcagcagcagcggatcgggattgcgagagccttggccgttgatcctcacgcgattttactcgatgaaccgacttcagcccttgaccctgagcttgtagccggggtgctccaagtcatcaaatcaattgccgaaaaacagacaaccatgatcatcgtcacgcatgagatggcttttgcgcgtgaagtagccgacaaagttatttttatggcggacggacgcatcatcgaacagggaacgccggaggagctgtttgacaatccgcagaacgaacggacgaaaaaattcattaagcaagtgggagagcctgccgaacttgtctaagaagggaagaagaagaaatggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaacttcaaaccggagtgatcgctgaaatcaaaggagataaaagcggccctgtcatcgccgtcagagcggacatcgacgcactgccgatcgaagagaaaacaaaccttccgtttgcttcgcgaaacagcggcgtgatgcacgcatgcggccatgatttccatacggcatctattctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcggcaggacagatcatcggcggcctgcaatcggttgtcagcagaaacatcagctcacttcataatgccgtcgtcagcatcacaagagttcaagggggcagctcttggaatgtcatcccggaccatgttgaaatggaaggaaccgtccggacgtttcaaaaggaagcgcgggacgctgttccgaaacatatgaagcgggttgccgaaggaatcgcggccggattcggggcagaggctgacttccgctggtatccttacctgccgtcagtgatgaacgacgcccgtttcatacaggcggcggaacaaacggctgaaagcctcggacttcaaaccgttcgggcagaacagtcgcccggcggcgaagacttcgcattatatcaagaaaaaatccccggcttcttcgtctggatgggaacaaacggaacagaagaatggcaccatcccgcctttacactcgacgaaaaagcgctttcgaaagcggctgagtttttcgcccggcttgccgtcaatgtattggagcagacggaatgaatacggaacatctgacggccggacttgctcaggccgtcatgtcgtctgtgccggaaacatccgctgaagcgatgaaagaagcgcgcaaaggactgcttgattttacagcggcggcttttgcggggagacgggataaaggcgttgaaaagctggtaaaactggccgaagaagaaggcggggtgccgatagcgccgcttatcggcagaaatcaaaaaaccacgccttcccaatccgcgctcattaacggattcattgcccatgcgcttgattttgacgatgttcattctgatgtaagaggacatccgagcgcggtcatccttccggctttgattgcagccgcatcagccggccggatagacaagagccgttttctcggtgcttatgtgacgggaatcgaagtgatggcgcggctcggcgagtcagctggaaggcatcattacgagaaaggctggcacaatacaggaacgttaggtgccattgcggccgcatgcgccgtcggattcgcggagaatctgaatcaaacccaattgcagaaagcaatcgggtttgcggctgcccgttccggaggcatgagaatgcaattcgggacagaaatgaagccgctccacgccggcctggccgctcaagccggggtgttcgccgtaaagcttgcaaaggccggtttcggcggctcagctcatgcgctcgacggggagaaaggttttttcggactgtacggcgatcttgaacgggcagaaaccctgcttgtaaatgggtggggaaacccttggcggatcgtgagcccgggactttggtttaaggtttatccgttttgctcggcggcccatcatgcggcggacgccattctcaagctgaaggccgaacatggtctcactttcggccaaacggaacggattgacgtgatttatccgccgggaggggacgccgcattgacagaacagcgtccgaaaacaggcgaagcgggccggttcagcgtagaatatgtgatcaccttggctttgcacggtaaggatttttcagttgaacatttcacatccgagccgattccggaatcccttcaaaaaggatttgagcggattcaccgtagctgcgatgaccaaattcagccagctgacaacgccgttccgaagggccgttttacaattgtacgggtcacggcttccggcggtcatgtctatgaagcacgtatcgactgtccgaagggagcgccgggaaacggtctttctgaaaaagacattgaagacaagctccggctcgctttgccgggagaagagaaaaaggcggaagaattgatcaaagcagccggacaatcaaatatggaccgttatttacagctgatataaataaaaagagcgaggggatgcagcccacgctctttttacgttcacttctattgaatagggggatatagggtgcgcccctgtctgcgctggcaggggcgcggtatcaggaaacggccgtgccgttttctttgaccgtgaaacttcctcttgataagcggatgttgatatcagacactttggcaatttgttcgtcgtgcgtaaccatgatgacgcatttgccgtctttatgcgccagatcctgaaagagccggacgatttcctttgacgtatcctcgtcgagatttcccgtcggctcgtccgcgcaaatcaaatccgtgtcacagcagaaagcccgcgcaattgaaacgcgctgctgctgtccgccgcttaatgtcagcacccgctgacgggcctgctgttcggtgatgccgactttatccagcatgctgagcgcgaacgcatctttgttgttctccttagatccggtaatctccatcgccgttgtgacattctggagcgccgtcatatacgggatcagatgataagattgaaagacgatagagacatattgatttctgaatttggttaatccgattttggagatgtcttctccgttataaaggatgcttccctctttaggtgtgtcaagaccgcccgccagagacagaaacgtggttttccccgtcccggaggcgccggcaattgtataaaacttccctttttcaaagctgatcgttatatcctgaaacagcggctgtgatttatcttggtaccagtagccggtctgttgaaaggttaataggctcattatgctgcctcctcttattcctgcttggtcaggatcgttttagggtgaagccgcatgactgatacagacggcagtaatgtggcgatgacggcaattgcgacgccgatcccgccgagaatcagaaggtcattcagcgaaacgtttacctgcattgtactgatgacatctgcaccggatgaatgctgaccgaacatgccgcctccccgcggcatttctcctccgccccagccgcttgtttgctgctgtgaatcatcggctgagctgacctgctgggaaagaagctgatttccgagctgattcgccacaaggctgcccgtgacggatgcgatcccgatggcgataaccgcgacaatcagaatttccgttaagaattgtccgatgagcttccagcgcttttcgccgatcgccattaagacacccatttcatacttgcgttccctgatcgacatcatcacgatcaacccgagaatgaccgcccccgcgatggatacaaggtacaccacgtttttagaaaatgacgcgacattttcaatcgggccgaccatttgctgatacacctgatcatttgtcgtcagcgtgtaggttttatcatctatagatgtttttttcgcagccgcaacgaatgagtcaatatattttgcatcatccatataataaacggctgagctgattttgtttttgttatcagacccttttaacgccgccgcggcggtgtaaggcgtatagattttattgtcaggatttaagaatgaaaaatgctctgcctgatcgtctcctgatgatgttgttttataaattcccacaatcttaagcttcgttttcactgaatcatccgctgctgaggaaaccgtaatggagccgccgaccttcagcttgttttgatctgccagcgtttcattgatcactgcgacttttgcgtccgaatctgtttttgtgatggcgcggccgtcagtgatttttgagcttccgcctgtgaaatcatcaagcagcgccgtagagagcacgccttcgaccgaaatgtccgctgaaatcatctgtcttccgccgccttgaaaacggcttccgccggaactgttatcggctgagtcgcctgagctttttatcgcgtcaaagctttctgcgtttgctgacgctgtcgtgaggaagttgtaatttttaacgtgctgtaaagatgtaagtttcttggcatccgagacggaaatcggcgctgattcaaacgtcctcttttcaccgtctttttgctgctgcgccatttgcttttggcggtcagcctggagtgtgacgctcccgccgagctgctgccttgccagttcgcttgatttctttgccgctgactggatcgtaagaccggacaggacaaaaatgcaaatcactgaaaacacaaccagctgcaaaaacgtttttcccttttttgccttcatgctccaaaaggctctttttataaagttcatgtctgttcctccgtgtgggtgtcagatcttgtaaaaccgaccttctttagaaccggttatccgatatgtatatagtaggagaaatgtgtgaaaaaaatatgaacaaactatttccgggtgatgaaataaaaactaacaattgtgaaacccgaaaatatccgggtaaaatggtgctattataagtaaaagcgtcaagataagcggaggaaccaatgaagatattaatgatagaagacaatataagcgtatgcaccatgacggaaatgttcttttttaaagaaggatttgaagccgaatttgtccatgacggagtggaaggctatcagcggttcacggaagaggactgggatttggtcattctggatattatgcttccatctatggacggagtgacgatctgccggaaaataagagagacgagcagtgtgccgattattatgctgaccgcaaaggacacggagtctgatcaggtgatcgggtttgaaatgggggccgacgactatgtcaccaagccgttcagcccgctgacgctagtagcgcggattaaagcggtgatcagaagataccgggcgacggggcagaccgtaaaaagcgacgacttgatcgaaacggcgtgtttttcaatcaataagaagacgcgggaagtgtttctgcacggaaagcctgtcgagaatctgacgccgaaggaattcgatctgctcttttatctcgcacaaaatccgcgccaggtcttttcgagagagcagctgcttgagcaggtgtgggggtatcaattttacggcgatgaacgtacggttgatgttcatattaaacggctgcgcaaaaaactgtccagtgaggaaaaaccgtttttatacacggtgtggggggtaggatacaaatttgatgaggattaaatacttatatcagctgctgttaagccatgtcagcattttgattttggcctttttcatcatcatttccctgttttcgcattttgtgaaagattttgcgtatcaaaataaagtggatgagctgtcttcttatgcccagcagatcacaagtgagctgaacggacgcgatcttgatctgcgccgcctgtatccgtatcaggacatgttaaaaacgcgcgagaccaggtttattatttttgatgaacatcagcggccgtacttttttcctgacgatatgccgccgcgcgagaagctgaaaagtaaagagtggcacttgctgaagcaagggaaaaccgttcagatcagagcggagatgaaccgttttaatacggaaggcttggaagtgtcgcttgtcgcaaaaccgcttttgatcaacaatcaatttaaaggcgcggtgctgctcgtgtctcccgtcagaggggtcgagcagatgatcagccaggtcaaccgctatatgatttacgcgatcatcagcacccttatcatcacgattctgctgagctggcttttatctaaatttcacgtcaagcggattcagacattgcgggatgcgaccggaaaagtggcgtccggtgattacgatatttcgctcaagaacagcggcggcgatgaaatcggcatgctggcgtccgacttcaacatcatggccaaaaatctgaagcaatcgagagagcagattgaccgcctggaaaaacggaggcgccaatttatcgccgatgtctcccatgagctgagaacgcctttgacgaccattaacggacttgtggaggggcttaacagcaacaccatcccggaaaaagataaagagaaatgcttctctctgatcagcgaagaaacgaagcggatgctcaggctcgtgaaagaaaacctggattatgaaaaaatcagatcccagcaaatcaaactggacaagctcagtctgccgctcatcgaggtgtttgaaattattaaagagcatctcaatcagcaggcggaggaaaaacaaaatcagctgcggattcaggcggaggacggcgtcaaagtgttcgccgattatgacaggctgatccagattctcgtcaatatcacgaaaaacagcattcaatttacgcaaaacggagacatcacgctgcgcgggtatgaaggctataaagaaacggtgattgagatcgaagacaccggaatcggcatctccaaagaggaaattgagcatatatgggagcggttttataaggcggacgtgtcccggacgaatacggcatacggcgaatacggactcggcctgtccatcgtcaggcagctcgtcgaaatgcacaagggcacgatagatattgacagcgaaaaaggaaaaggcacgacctttacaatccgccttccgctgaatacgaaacatgaatcatcttgaaaccggcagtcccgtctggctgccggctgttttatcttcactcggaaaattgcgctctgccgaaacaaagtttgcgtgtttttcgggatggaaagacacggaaacgtgataaaataactggtaaacaggtcttggatggggagggtgaaggaatgaagagcgggttaattccttcttcagcagtcgggcagaaaattaacgagtggtatcgatacatcagaacattcagcgtgccggatgcggagatcttgaaggccgagatcaaacaagagcttgaccgtatggagcctgattcaaacttagtgctttattattccctcatggaatttcgccatcagctgatgctggactacttggagccgctggaaaaactgaagatagaagaccagccgaccctgtcggaaattcttgataacattgataacagccaggccggcctcaaagggcttctcgattattacgtcaactttttcaaaggcatgtttgaatttgataaaagagaatttatctcagcgattacgtattataaacaagctgagaaaaaactggccttcgtatcggaccacgtggaacgggcggagttttattttaaagtggccgaagcttattatcatatgaaacaaacgtatttttctttgatacatataaaaaacgcttatgaaatttacgtagagcaagacacatataacgtccggatcattcaatgccattttgtattcggcgtcaatttaatggatgaaaggcgctttgaacaggcggccaaacattttcagcacgctctgcaaatggccgaaaaagaacaaaaagcgcagcttgtcgggagggcgctgtataacctcggactgtgctactacaatcaggaccgcatcggcgaagcgattccgtactttgaacgggcggttgatacatttgaatcacaaagaatcgtcaattctcttcctcaagcatatttcctaatcacactcatttactttaaactcggaaaaaaagaaaaagcgtcggaatatcacaagcggggatatgaatatgctaaagaaacagacgatcccgtttacacggtaaaattcgaatggctgcaggctctgtatcaggcgaaaccggatgaggaaaaaatcagcgcatgtttccgttacctggaagataaaaatttatacgccgatatagaggatttagcactagaagcagctaaatattactatgaacaaaattgctttaagatttcttctgactattttctgaaagtcgaagaggcaaggaaacaaatacaaaggagtgagggtttgtatgaaattgaaatctaaatggtttgttatttgtttagcagccgccgcgatttttacagtgacaggtgcaggccagacagatcaggctgaattccatgtagctgaaagaggaatgacgtgagaagaaaataacctgaacaaaggaaaagactgcccgggaatgttcccggcagtcttttttttgcgcggccggacttggacagcggcggaaaacaaaagaaaacgccgcaggtcaaaacccgcagcgtcctcatatagacggagtgatgcttagaaaccgccaacataggcagtacctacaataaccaacaggataaataaaacaacgatcaaagcgaaagagctgattccagaatatcctgacatgagcttcacctccatattgtctataccatacaatatgtaaaagaagctgctttgtaagggatattagtggacaagagaaaaaagaggcggtgtcctatgagagtaagactccggcaaaaaactcgtcatacagcgcccgcaccgcgtgtttttcctgttcttctttcaccccgaacatcatgctgacttccgatgacccctgattgatcatctcgatgttgacgccggcttcggacagtgctttggatgccctggcggttgtgccgacattatggcgcatcgcttccccgacgaccataatcagcgccaggttgtgcctgactgtgacttcatctgcttgaagttcctgcttcagacgggtgacgagcctgtgttccagttctgagtccatctgatcgtgccgaaggatgatcgtgatgtcgtcaatgccggatggaacatgttcatacgtcaatccttcttcctccaaaatgtgaagggctttgcggccgaaaccgatttcccggttcattaaatatttgcttatgtaaatgctgcaaaagcccgtgtcgcttgcgatgccgatgactggcccgttcgtattgtcacggctgctgacgacgcgcgttcctttcgcatccggattattcgtattcttaatctgaacggggatgccggcccgaaaagcgggaatcagcgcttcatcatgaaaaacggaaaacccggcataggagagctcacgcatttcccgatacgtcagttcgttaatttctttcgggtgccgcacgatcgacgggttgacggaatagacggcgtccacatcagtaaagttttcgtacaggtcggcttttaagccgctggcgagaatggagccggtaatatcagaaccgctccgggaaaacgtcacaatctcatgctccttcgtgtaaccgaaaaatcccggaaaaatgatcaagccttcacggtttctcagacggtacaaatgatcataagattcagggagcacctgcgcgcttccgggttcattcgtcacaaacagccccgcttctttcgggcttacgtattcggctttcacgccctgccggcggaagtaggccgcgatcagcttcgcgttgttgtcctcaccgctcgctttcaccgcatccatatactgatcgggattggctttgctgctgtttaagagagcgaataggtcactgcggattctttctataatagagaaatccaggttcagctcacgcgcgatggcggcgtaccgttcaatgaccggttcggcaagctcgggcgctgcacctttttgcaaataatgctccgcacagcggattaacagatccgtcacctttgtatcgtccgagaagcgttttcccggcgccgatacgacgacggctttccgcgagggatcagccgtcacgatttgaaacactttctcaagctgggctcctgacgcaagagagctgcctccgaattttacaactttcatgatttacatcccctaatatttaaattttctcacaaatttaatttttattatctctctttcaaacatgtaaatcaaggattttttctacgtagggagaacatttgtattttcctggaggaattttgccgctgtttgtcagatttttttccctcaagcgtgtcatcatgtgcaaaaaatgataagcagccaaatgaaggttatagaaaatcctgcaaattcttgatagactgattgtaaaacaatttagtgtacggcccgcggatgaccgcttttgaaagcaaaactgtattgactgcgcttggaaagatgataagattatagttgtcgttgataatgataatcattacgagtggggatatatgggagttgtttggcaatcagtcataccgtttgtgatgggtgcagggaggcagcatgaagctacgttacttacttttgctactggcggttttggcgtgtacttctatatttatcggtgtagaagatttgtcgccgctggatatttttcatttaaataaagaacaggcaggtacattgtttgacagccggctgccgcgtttggtgagcattatcatcgccggcatgagcctgagcatctgcggattaatcatgcagcagatcagccggaataaatttgtatcgccgacgactgcgggaacgatggactgggcaaggctcggaattttgatttcattaatgctttttacgtcagcgagtccgcttgtgaaaatgtctatcgcttttatttttgcgttggcgggaaatttccttttcatgaaaatcctcgagagaatcaagttcaatgatgcgatttttattcctctcgtcggtttaatgcttgggaatatcgtcagctcaatcgccacgtttatcgcatataaatacgacctgatccaaaacctgtcatcttggctgcagggagatttctcactggttgtcaaaggcaggtatgagcttttatatctgagtatcccgctggtgatcatcgcttatgtctatgcggataaatttacggtggcgggaatgggagagagcttttccgtcaatctcggcctgaaatacaaacgcgtcgtcaatatcggtctgattatcgtgtcgctcatcgcttcactggtgatcctgaccgtcgggatgctgccgtttctcggtttgatcattcccaatatggtgtcgatttacaaaggggacaacctgaggagcagcctgcctcacacagctctcttgggcgctgtttttgtgctgttttgcgacattttgggaagggtgatcatcttcccgtacgaaatttccatcggcctgatggtcggtgttatcggcagcggcatcttcctgtatatgctgttaaggagaaaagcatatgagtcataataaaaaaattacgctgctggcggcgctcgccatgatatgtatcggattctttctgttctacggactgggcaattgggaatactccctgccgagacgatgcttcaaagtgcttgccatgatgctcacagggggagcgatcgcgttttcaacggtcatcttccagacgattacaaataaccgcatactgacaccgggcattttaggcctcgattccctgtatatgctcattcagaccgtcatcgtgttcctgttcggttcaatgaatatcgtcatgatgaacaaaaatcttaatttcgtcatctccgtcgggctgatggtgctcttgtcactcgttttgtatcagctcatgtttaaaggcgaggggcggaacgtgtttttccttctgcttgtcggcgtcgtgttcggcacgctgttcaacagtctgtcatcctttatgcagatgctgattgatccgaatgagttccaggttgttcaggacaaaatgtttgccagctttaacaatatcaacaccgatcttttaggatttgccggtgctgtctttcttctgacaggcatttatgtctggcggttcacgcggttttttgacgtgctgtcgctcggcagggagcacgccgtcaaccttgggattgattacgataagcttgtgaaacagatgctcatcgtcgttgccattcttgtgtctgtctctacagctcttgtcgggccgattatgtttttaggactgcttgtcgtcaatctggcgagagagtttttaaaaacctacaggcacacgtatttaatcgcgggttccgtcctgatcagcatcgtcgcgctcgtcgggggtcagttcgtcgtggagaaagtgttcacgttttccacgacgctgagcgtcatcattaattttgccggcgggatttattttatctatctgctgttaaaggagaataaatcatggtagaggtcaaaaatgtaagcaaacaatacggagggaaagtcgtccttgagaaaacgtctctatccattcaaaagggcaggctcacctcgtttatcggtccgaacggcgcgggaaaaagcacgctgctgtctatcatgagccggctgattaagacggattccggagaaatcacggtcgacgggcaagagatcggggcctgtaaaagcaacgatctggcgaaaaaaatcagcatcctgaagcagacgaaccaaatcaatataagactgacgattaaagacctggtcagcttcggcagatttccgtattcccaggggaaactgacggatgaagattgggtgcatatcaatcaggccctcagttatatgaagctggatgacttaaaggataaatacctcgatcagctcagcggaggccagtgtcagagggcgtttatcgcgatgatcatcgctcaggatacggactatatttttctcgatgagccgctgaacaatttagatatgaagcattccgttgaaatgatgaagctgttgaagcggcttgtggaagacttcggaaaaacggtcgtcgtagtgattcacgatatcaacttcgcatccgtatattcagaccatatcgtcgcactgaaaaacggccggatcgtcaaagaagggccggcggaggagatcattgaaacctccgtgcttgaagatatttatgatatgaccatcccgattcaagagattgacagtcagcggatcggtgtgtacttttcttaaaaaccagatgaggtgaaagtcatgaaaaaattcgcattgctattcattgcgctagttacgatttttgttgtttctgcatgcggaaacggggacaaaacatcaggcaaatcaaaagaaacaatcacaatcaaagatgatctgaacaaagaaggagtcaaagtgccgaagaatccgaaaaaagtcgtcgtattcaacttcggaatgctggacacgatggatgaactcggtttacaggatcacgtggcgggacttccgaaacaaaaccttccaaaatacttatcttcatataatagtgataaatacgccaataccggcggtttaaaagaaccggattttgaaaaagtcgcggatattgatccggatttaatcattatcgcccacagacaatctgattcttataaagagttctcaaaaatcgcgccgacgatttatcttgatgatgactatacaaactacgttgacagattcaagcaaaacactgaagtgatcggcaaaatctttaacaaagaaaatgaagtgaaagataagcttgcgaaaatcgacaaatccattgccgatctgaagaaaaagacaagcagcacggataaaaacgggttagtggtgatggcgaacgacggcaaaatcagcgcgttcggatctaaatcaagatacggcttcattcatgatgtgttcggcgtcaaaccggctgacaaaaacatcgaagcctcactgcacggacaaagcatttcctatgaatatatcgccaaaacaaaccctgattacatgtttgtcgttgaccgcggaacagcgatcggcacaaaatcttcaacaaaacaagtggttgaaaatgattatgtaaaatcggtgaaagccgtgaaaaacaaccatgttgtctaccttgattcagctacatggtatttatcaggaggcggcctggaatccatggcgcaaatggtgaaagaagtaaaagacggaatcgagaagtaaaaaaagaacccggtcacatacgtgatcgggttctttttggtttaccgcgtcacggcctgctgctgctcgggctgacgcggttttttcttcaatgtaaaagataggaggaagccggccagcgcgatgcaggcggctacgacaaatgccgcattcatgccgtgcagggcagcgtttgccggagttgacgcattggcgtgcgcggcctggctgctcatcacggaaaccagcagcgccgtaccgatagaaccgccgacttggcggacggtattgttcatagctgtgccgtgcggaattaagtggcgcggcagggcattgattcccgcggtcgtcaccggcatcataatcatggctgttcccaaaagccgcgcggtataaacgacgacaatccaaatgagagacgtcgagtccgtcagattcataaacggcagggacgtgagcaggatgatgaagaatccggtcatcgcaaggccttttcctccgattctgtcaaacacccggccgataaacggagacatcatccccatcacaatcgcgcccggcaaaagcattaatccggtatcaaacgcggatacgccccggaccttttgcgtgtaaagcgggagaatggtttccgttccgatcagcagcgcgaaaacaagcgttccgagcagggtggtcaggctgaaaatcccgaaagaaaacacacggaattccagcatcggttttttgagcttcatctgtcttgcgataaagaaaatcagcgcggccgctccgacaagcagcgaagtcagcacttcagtactggtccatcctgaggaaccggcgcttgagaagccgtaaagcagcccgccgaatccgagggtcgataagatcacggataaaatatcaatctgtgtttctcgtaatgtcgtgacgtttttcatcagaataatcgctaaaagcaaatcgatgactgcgatcgggaagatgatgtaaaacaaagaccgccaagagaatgcttcgaccgcccatccggaaagcgtcgggccgatcgccggcgcgaacgaaataaccaagccgaccatacccatggcgcggccgcgcttttccatcgggaaaatcgtgagaaataccgtctgcatgagcggcagcataattccggcgccggccgcctgaataatccgggccgttaagagcaccggaaagttcggggcgaatgcgccgacaatggtgcccgccgtgaaaatactcatagcggaaatcaggagggtgcggctcgtaaatttctctattaaaaatgcggtaatcgggattaaaatcccgttcgtcagcataaacgatgttgtcagccattgcgctttgttggcgtctatattgaagtcattcataatgtgcggcagcgccgtgataagcagtgtctggttcaaaatggcgacgaacgctcccgccaaaagaatcccgacaatgacagagcggttgtatggtgcagtttcaatactcttattcaagctgattccttctttctttatagtttgagcaatgttttaacggctgcaagcggctggtgcagcggtccggcctgctccaaataaccgatgagcgcttttataagaaaatcccgcggctgtttgtccgctgattctttctccagcataaccgccgcggaagcgagtcctgcggcatcatatttttcctccggaagggctgagacggcttctttcagttccttcaggctttcagccagcaatacggttttgtctttcggctcaaatgaggaagcggaggcggtataaaggtcaatcatctcctgaggcaaagccgtttcggttttcctgttttcgacgatgagattgagatggcggatgataaagtccgtgagcggctccagagcgagcggttctttttccagcttaatcagcgtgatgcattctctcaggagcccctgcaggacgatcaccagctcccatacataaggaataatgtcttcgccgtacgtctgaatcagtgaatcgcgatgccagcagataaaggtggagcgggccctgtgaatatgccgttttacccgctcattaatggaagaggggcttccgtacatcagcatattaaaaaactgctgattgcgcctgaagccttcaagctcagccatcagttttttggcaaaccgttcctcaggggagaggctcgtttcttcattcaataatgaagcggccgctaccatctgtttctggttaaaatcgagcagctccaggagcaggtcttcctttgattcaaacagcttatataaagatgctttggagactttgcactcctctgcgatcgcctgcatcgaaaccgacgaaaagcttttcccggaaaaaagcttccttgccgccagcagaatatccgttttcttatcattcataagcccagattccttctttcgtcacaatagaaaacccatcggttcacagaaaaccaatgagtatatgatgaaaatattaacaaaaatttttacatagtgtcaacgcttttgtttgagaaatagaaaaaacctgccggagtgttccggcaggctgatacgtttatttatccgtcttaaatccttgtttttcaagcatttcacgaatgtgaggataataaacctgcttatagtaggaagtgatgccttgtgaccagtttcttgtttcctgtccgtcggtgcgttttttcatgtattcggacatctgcttgtcataggcctcgatatgggttcttaaatcttcttcttgatacgtttcatgatgcagaacggctgcttgcggcagacgcggttttttcgcggagcggtctgccggatggccgatgacgagaccggaaaccgggaaaacgtatttcggaagtttcagcaattcaatgagttcgtcaggcttgccgcgcacggcgccgatcggcacagtgccgagtcccattgattcagccgcagccgttgccgtacccagcgcaatcccgacatctacggctccgactagaacggactctaaaccgttcgtgatctcaagcggtgtatcattatattcttccagcgcaattttggcgcggttaaaatcagcgcagaataaaaggaaaaccggcgcttggtcaatccacggctggccgccggccaattcggatatttttttcttccgctccttatctttcaccgcaataacggtaaattgctggccattaatggaagtcggcgctgcctgagttgcttggatgataaggtccagctgctcatccgatacgggttcatctgtgtagctgcggatggaacggtggtctgttaatatttgaaggacttcgttcatgtcattcatcctttcgttactctgacagttctgtgcggacgacgtcaagcggcgcactcagcacttcttttgcttttgccacgaatccttggaaatggtcagttgcgttgtggaatttcatcgcttcttcatctttccattgctcaagcataacgaatgtattttcctcaccgactttttcgaaaagatcgtattgcacatttccttcttccgcgcgtgaatgctgaacaagtgattgcgcttctcctaaaaattcctcgcgtttatccgcttttactttcatgtaagcctgtaagacgatcattgttattcctcctgattgggtttatttgttatagttcgaatattatcgaactaactgtaacatgtttcgcagtgaatggtaaaggaaaaaccctcaccgcctaaattgtcacccgccgcttttatgtgttacatttgactcatgaacattccaaaccatcctgaaaccgaccgcttacagctgacaaaggttcttcatgctctgagtgatccgctccgcttagagctggtcaaacaattggcggaaacaacagaaaaaacgtgcggtacctgcgctgatgtccgggtcgctaaatcaacgctgtcccatcacttcaaagtgctgcgggaagcggggatcgcccaagtgcgcatagacgggaagcaccgttattattccctgcgcaaagatgatttacaagcggcgtttcccggcctgctggaggcgattttgcagacagaaccggaccgctggtaaataagtccccgaattccgggggtttttttatgcgccgaaaaccgcccggtaaagcctgaggacgccttcttgaatatcgctctccttcaggcgggcgaaccccagaatgagctgcggcttatttgaatcgcctcccgttttcagacggaaccggctcatcgcaaacagatcgagctgttctgcatccgcccgtgccaatatctctttttctgaacgggcgcagtcaaactcagtgacaaaatgaagccccgcattggcgccctttacactgattctttctccgaatgtttcttccaaagccgaaatgaggcgttcccgcatgttcttataatgctgcttcatctttttaatatgtttctgatattcacctgagtcgataaattctttcagcgcgagctgggcaagcgtgctgcacgtatgcaggtcatacgttctctctttgaacgtccgcaaaagcccgggcggcagaaccatatagctgatgcgcagacctgggaaaagggattttgaaaaggtccccatgtagatgacattttgaaaccggtcaaggctttgaagcgccggtatcgtatcggcgtcatatttaaattcactgtcataatcatcttcaatgatgaagcggccgttctgttcggcggcccagtttaaaagctgaatccgccgggaagcgggcatgatcacgcctgaggggaattgatgggaaggcgtggtgatcaatacacagggccggcgtttttcgatttcggccatggacatgcctttttcatcaaggctgatcgtcgcaacctttttcccgaggttttgcagcagccggtacatcctcatatatcccgggttctccatggcgtacagcgcgtcttttggcagcagttccgtcagcagctgcatcagcatttgcgtgcccgcccctagcacgatttgttccgggcggcatgtaacgccccttgtcagggaaataagccgcgaaatggtttcacggacttcatataagccttgcggatggacgaggtctccgagtgtatgaaatgaacgggcggctgctttatgctcacagcggaaccagcttttcaggggaaaatgcgccgtatccacgctcatatgagaaaacgaaatccagccgctcttatccggctcccgctcttttaaatcttcaggcaatgagagcgaaggcgtttcttcatgataaaccgtatcaatttcctccacgaaaaagccttttctttcgactgcatataaataaccttccgaaagcagctgctgataagctgaattcactgaattcacgctgaccttcagcgtctcggcaagctcccgtttagacggcacctttgtatgaggcatcaggctgcgtttcaaaacggccgcttttatgtgctgatagatctgctgatagatataatccgccgtttccgaatgatcaatggaaatcgtcagcatccagaccctgctcctttctgataccatggaaaaattgattttggtacttttcatcataccaaaaagaagtcagaatgataagaaaacaatgcagggggatggaatctatgagtcgaacagcattatcggaagtgacaacagcccagtggcagcaaaaacgggatcaattcgtttccaagggggtcggcaacggaaaccgcagcatggcggtaaaaggggaaggggcgcttttgtacgatttggacggcagacgattcattgattttgccggagcgatcggaacgctgaatgtcggccattcccatccgaaagtggtggaggtcgtgaagaaacaggcggaggatctgattcacccgggatttaacgtcatgatgtatccgtcttatattgagctggctgaaaaactttgcgccattgcgccgggagatcatgcgaaaaaagcgatttttctcaattcgggggcggaagcggtggaaaacgccgtgaaaatcgccagaaaatatacgaagcgccaggctgtcgtgtcatttacaagagggttccacggccgcacgaacatgacgatgagcatgacgagcaaggtgaagccttataaattcggtttcggcccgtttgcctcagaggtgtatcaggcgccgtttccttactattatcaaaagccggccggcatgactaacgagcagtatgacgactttatcatcagcgcttttgaggatttctttatcgccgcagttgcaccggaaaccgtcgcctgtgtcgtaatggagccggttcagggagaaggcggcttcatcattccttcaaaacgtttcgtgcagcacgtcgccgctttttgtaaaaaacacggtatcgtttttgtagcggatgagattcagaccggttttgccagaacgggaacgtattttgcgattgaacatttcgaagccgtccctgatttgatcaccgtatccaaatcacttgcagccggattgccgctgagcggtgtcatcggccgggcggaaatgcttgatgccgccgcgccgggggaactcgggggcacatatgcgggaagccctctcggatgtgcggctgcgcttgccgtcctggatattatagaagaagaagggctgaatcagcgttccgaagagatcggccggatcatcgagcatcaagcgctcgagtggaaaaaagagcatgcctgcatcggagaagtgcgcagactcggcgcgatggcggccatcgaaattgtcaaagatccggacacgcgggaaccggacaaagcaaaagccgcggcgatcgctaaaacggcgaacgagaacggactgctgctgctgaaggccggcattaacggcaacattatcagattcctgacgccgcttgtcgtgacggatgagcagctcaaagaaggcctttccattatcgaagcagctctgtgagttcaattattggaatgccgccggatgtgtctgctatcatgaaagtgtgagatacatcaacaagcattcaatggttttactataggaaagaaaggaatgttcaatatgccagaacaattaacagtgtacaacccggcaacgggagaggcgatcgaaagcatcccccagcagacggccgaagatgttgaaaaagcgattgaacgttcacatcaagcgtttcaatcatggtccaaaacatcagcgggagaacgtgcctcacttttgagaaaatggtatgagctgattgttgaaaataaagaagaacttgcggaattaattacgaaagaaaacggcaaaccgtacgaagaagcggtcggagaagttttatacggcgccggctatattgaatggttcgctgaagaagcaaaacggatttacggcagaaccgtacctgcgccgacaacgggcaaacggattgtcgtcacccgtcaggcggtcggcccggtagccgcgattacgccgtggaatttcccgaatgcgatgattacaagaaaagccgcgcccgctttggcggcaggctgtacgttcatcatcaaaccggcggaggatacgccgctttccgcttacgcccttgcgcgtctcgcatatgaagcgggaattccgaaggacgtgctgcaagtggtgatcggtgacggagccgaaatcggaaacgtcttcaccagcagcccgaaaatccgcaaaattacctttaccggctcaacgcctgtcggcaaaattctgatgaaaaacagcgccgacaccgtaaaacatatgtcaatggagcttggcggacatgcgccgctgatcgtggatgaagacgctgatcttgatctggcggtagcccaaacaatggcctctaaattcagaaatgccggccaaacctgcgtctgtgcgaaccgtctgatcgtacacgaatccgtgaaagacgagtttgcgaaaaaactgagtgaagaagctgcgaaactcaaagtcggaaacggtcttgaaaatggcgtaaatgtcggccctgtcatcaacaaaaaaggcttcgataaaatcgtcggccaaattaatgacgccgtggaaaaaggcgcaaaagtgctgacgggcggaacgtatgaccaaaacgatgaaaaaggatgctatttcgtgacgccgaccgtgctttcaaatgtagacacatccatgaacatcatgcatgaagaaactttcggcccggttgcgccgatcgttacgttctcagatattgatgaagcgatcaagcttgcgaacgatacgccgttcgggcttgcggcttatttcttcacagaaaactaccgccgcggcatctatatttctgaacagcttgaatacggcatcatcggctggaatgacggcggtccgtccgcggttcaagcgccgttcggaggaatgaaagaaagcggcatcggccgtgaaggcggtacggaaggcattgaaccgtacctggaaaccaaatacatgtctatcggactttaatgagccgaaaagaaagccccgcttctaagcggggctgtttttattgagcggtctgccggtgaatatcgccggcaggcttttttgatcttgcgggaataatcggttcgattccagacaaaataacagcaaatacgattgaaagaaggtcgccatcatggatatattactggctcttctcccggctttattttgggggagcatcgtgttatttaacgtcaaattaggcggcgggccttacagccagacgctgggaacgacaatcggggcgctcatcgtttcgtttgtgctgtatctgtttgtccacccggtcctgtccgggcgcatttttattgtcggcatcatctcggggctgttttggtcgctcggccaaagcaatcagcttaaaagcatacagctgatgggcgtttcaaaaacgatgccgatatcaacgggaatgcagctcgtctcgacttctttgttcggtgtgatcgtattcaaagaatggtcaaccccgatcgcgattacgctgggtattctcgcccttatttttatcatcatcgggattgtgctcacatctttagaagataaaaaggggcgggcggacggagaaccgggaaacttaaaaaaaggcattgttatcctgctgatctccacgctcggctatttggtctatgtcgtcgtcgcccggctgttcggcgtatccggatggtcagcacttctgccgcaggcgatcgggatggtcatcggcggactgctcctgacgtacaagcataaaccgtttaataagtacgccctcaagaacattctgccgggaatcatctgggcgctcgggaacatgtttctgttcatctcacagccgcgtgtcggagttgcgacaagtttttccctctctcaaatggggatcgtcatcagcacgctcggcggaatcttcattctccgtgagagcaaaacgaagcgtcagctggtcgccattgccatagggattatcctgatcattgtagcggcggtattcttaggcgttgcgaaatcaaattcataacatatgcaggaggtttgaacatgtacacggatttaaaaggaaaagtcgttgccattacgggagcttcatcaggattaggaaaagcgatggcgatccgcttcggacaggagcaggcgaaagtcgtggttaactactatagtaatgaaaaagacgcccaaaccgttaaagaagagattcaaaaagcgggaggcgaagcggtcatcgttcaaggagacgtcacaaaagaagaagatgtcaaaaacatcgtgcagaccgcagtgaaggaattcggcacattggatgtcatgatcaataacgccggcatggaaaatccggttcagtcgcatgaaatgccgcttaaagactggaacaaagttatcaacaccaatctgaccggcgctttcttaggaagccgcgaagccattaaatattacgtagagaatgatattcaaggaaacgtcattaacatgtcaagcgtacatgaaatgattccatggccgctgtttgttcactacgcggcgagtaaaggcggtatcaaattgatgacggaaacgctggcgcttgagtacgcgccgaagcgcatccgtgttaacaatatcggaccgggagccatcaatacgccgatcaacgcggaaaaatttgcggatcccgttcagagaaaagatgtggaaagcatgattccgatgggatatatcggtgagccggaagaaatcgcggctgtcgccgtctggcttgcttcaaaggaatcaagctatgtgaccgggattacgctgtttgctgacgggggaatgaccaaatatccgtcattccaggcaggccgcggataagaaaaaaagcgatcgcaggctctttagagccggatcgctttttgcttacgcgcgttttttctttacaagcgccgcgatggaaaggataatcgccgcagctgacagaacgatggctgcaatatcaagcgctgatacgccggatttgctttcttcatttgactgttcagctccgtgcgcatccgtcacgctggccgatttcgtgattttcgtaatcgagtggggcgtgtcggctttctcatcacccgtccattctacaatgctgccgtctttgtaatattgataagcgtcccaagcggcatctccgctcttttcaggatttttcgcaacgaacgtgaactgctggaattggccgggctgaatgccgccgtcctttgcttcccaagtgacggagaccgctttgtcatcatgtttggatacggatgttttccagcccggaatcggctgatactgctgaaattcaacgccggcgggcattttcagcacgactttcgttgtcggctcattcttttccacaggcactttcatcgtgtacgtttcccaagaaccggccgcggattccgcgggtttgactgagacgtgggcgcttgctgcagccgtaaaaccgacgagtgacagggtcacggcggatatgaatattaaagccttttttttcaacatgagatacactccttagtttgtcgttgagaatatttggttgatttcattaaaatcgtttgtcagtccgtggactttgatcttccagtttcccttttcggtgatggacaggttggcggcttcgaatgtgccttccttcgtcttcttcaaatcaaaggtgctttcatgctgtttgccgctgaagcccgtctggtaaacagtgaccgtaaattgctgaatgtcttttactaagctgccgttatgatcggtgacaatgacttgaaattcatttttacccggctggttcggcgtaatgtgcaaggatagggtctccccgtttccgatcgtttctgagccgttaaaaggcaatggcgcaggcggcggcgggctgggcaggcttgtgaagacggcggttgtgaataacaccgcaataccaagtgcccattcggcctttatcgttgcgctgatgctcctttttctgctgaacttcgtcatccatacgtgaacggcgccgagcgcaagcatgatgacaaacagtccgattttcaaaaggagcgtcttgccgtaagcggtgtgaaagagtgaatcaaacgagcggataatgaaaaatccgttcagcacacctgaaaataacagcacgccgacagaggcgaacgcccaaggagaaaaccgtctgaccgtttcccaagcgatggttttatcggtttttctccactctgatgaaagaagcagcacaagagcggctataccgcccatccatacagacgcggccgataaatgtagaaagtccatcacgatgccgaccgctttttcgtcgataacggctgcatgcccggcgaatgcttttgccaaaagcgaagcgaagaagagcaacagcggcgccgtccagtacgcaaatgaccgaactgctttcttcttcagcagcgggatcatggacagggcgagcaggataaataagctgatctggatcatccagacgtacccgcctgccgttttcagaagcgtttcttttacatagtccggctgaaacgcggcgctccaagcgccgcccgcgttttctttcgtctggatcgggagctggcacacgagcgcgagccccgttaaacataaagaaatcacgagcagctttacagttcgttttgcttttgatgaatcttcattatttctgtaccaaaacagatggaaaaaagccgtgccgataaacagggagagagcggtgtacaaaataccgcggtcgatggccgcttcgggatgaagcgccgcttgcgatgatgtctgctcctgaagttcaccgccggcttttccgatactgaaagggatgacgccggataccggatgtccgtcggccgataccgcgttccattccgctctgtaaatatcatgcggcagattttttttcaatgccgcggtcatgatgcgggcattatttttttgaatcaccgttttgcccgcgtcaacccgttcgccggatgaattatagaccttaatggagtggaagccttcttcaatctgttcattaaactcaatttcaatctgcttcggcgcttgttttaattcgctgttctcacccggatttgagtttgtgatgtaggcgtgggcgaagcttgttttcggaatcaaaacaaggaacagcaaaaagatgagccagcgtttgttctgtctcatggatgatgacaccgccttccggttggttgttgttatgtcttgctgcaggtgcatcccttctgcctgtcgtgtaagatgatgtccgccgcctcgtcaaaggtgcaaatgaccccgccgaatcctttttgaaaccgttctgcgtaatcaagcgttgagaagggaatcgcctgaggccggcagcagtgaaggtcaatatcggcatggactaaaaagtatgcggaagcggccgtcagtgtcgtctggagaagaaaatccttacaaatgacgtgggacacttcttcctttttatcctcataccgcaaaatcgcgcaatgaatgcagcacatctgctcaacggcttgggaaacggtaataagctgaacagaatacgaatgctgaatcggccgcaggcaatagccgcattgattggcgctttgttctgaagcgtgagggagcgtaatgccgccgggtgtccggataatccggtttgcatccgccagctgattgacgtctctgtacacggtcatctcggagacgccgaatctctcgcttatgtcagagattttcagcgcgccctcttctttcagccattcgagcaaggtttgctgtctgtgaatcggaagcaattctgcatcctcctttttatgcgaatgagtgatgaacctccctctaagagtagatgttttcacaaatgcacacaagagcctgatgataaaatatgtgaaaaaatgttgaacaatcacaaatgtaaaacacgcagtcggactctgttataatagaagagttgaatggaggaataaacatgaaagaaacgacctgcccgaactgcggcaagccgattacaggcgacatggtcagatcatccatgatcccgtgccagtttcagtgcgggcattgccatgtgaaattgcgtgaatataaagtatcagctccgattatggctgcggccattgcgatcacggtgcttttgatttatcttgtgcagatggccagaaccgccgtcatgccgatgtttccggcagcgcggtatgtgccggccgccattttcgcgctcgtatgtgcgtatccggtgtttattgtcagtgagcggctcattgccaagctcgtcgtcacaaaaggacacattatatacagaaagcggtaagacacctttgatgaggtgtcttttttttgttaaggatttgtcacagtctctgtgccaaactcctctttacttttcattgaatggggattgtaagcgttttatgatgaagacacaggggagagagaaaccccgtgtcttatttattttcatctgaaggcaggcaaacagggagggaatgaacatgcagcaagaacagcaagctggcatgaaagtgaagatacagcggttcggcagttatttaagcggtatgatcatgccgaatatcggcgcatttatcgcatggggaattatcaccgcgctgtttattccggcgggatggtttcccaatccgcagctgaatacattggtaagcccgatgattacgtatcttctgccgcttttaatcgcatatacgggcggaaaaatgatctatgatcaccgcgggggagtcgtcggagcgacggccgccatcggagtcattgtcggagcggacattccgatgttcttaggggcaatgattatggggcctttgggcggttatctcattaaacaattagatcgtgtgtttaaagataaagtcagacagggttttgaaatgctgatcaacaacttcacggcgggaattatcggcgcagtgctgacgattatcgcgttttatgcgatcggcccggtcgtcctgtctcttaacaaattgctggcggcgggtgtggaagtcattgtccacgcgaatttgctgccgattgcaagcgttttcgtagaaccggcgaaagtcctgttcctgaataacgcgatcaaccacggcattttaagtccgatcggaatcgagcaggccgccaaagcgggtaaatccattctgttcttagtggaagcgaaccccggaccgggactcggtattttactggcctatatgttctttgggaaaggctcttcaagatcaacagctcccggagcggcgatcattcatttcttcggggggattcatgaaatctatttcccttacattttaatgaaaccgatgctgatcctcgcggcgatcgccgggggagcgagcggactgcttacattctcgatctttaacgcgggtcttgtcgccgcatcatctccgggaagcatcatcgccattttggcgctgacgccgaaaggaagctatctcggcgtgctggcgggcgtcatcgttgccgcggccgtatcgtttatcgtctcggcgcttattctgaaatcgtctaaagcgggcgaagaagatttgacagccgcggcggaaaaaatgcaggaaatgaaaggcaggaaaagtgaagcggcggccgcattggcagacaaagaggaagagccggaaaacagcgccgctgatatttccgctgaccaagtcagccgcattatcttcgcatgtgacgcgggtatgggatcgagcgcaatgggcgcctccattttaagaaacaaagtgaaaaaagcagacctggatattgatgtgacaaatacgtcgatcaataatcttccgaatgacgcggatatcgtcattacgcataaggacctgactgaccgcgcgaaagcgaagctgccgcaggcggtgcacatttcggttgataatttcttaaacagcccgaaatacgatgaactgattgaaaagcttaaaaactaatcaaacagaaagagggatcttcatcatggaagtattggctaaagcgaacatcaaactgaaccagacagtgaactcaaaagaggatgccatccgcctggcgggacagacgttgattgataacggttacgtgaagaacggctatgtggaaaaaatgttcgaacgtgaagaaacatcatccacgtttatggggaatttcattgcgatcccgcacggaacggaagatgcgaaggatgaggtgcttcattcaggcatttccgtcatccagattccggacggtgtggaatacggtgaaggcaatacggcaaaggtcgttttcggtatcgccggaaaaaacaatgaacacttagacatcctgtcaaacatcgccatcatctgctcagaggaagaaaacattgaacggctgatcagtgcaaagacggaagaagaactggccgctattttcagcgaggtgaactgacatgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgctccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggataatcttacacctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcgtacggctttaagcaagccgaacacgagcagtacatgaaaaaaatcatcagccgctttgataatgaatacatcacggatgatgtgacaagagtcgccagatcaccgctcagaaaactcggagcgaatgacagattagtagggccggccaaaaaaataaaagaaccgaatgcgctggcggaaggtatcgccgccgccctgcgctttgactatcaggatgatccggaagcggttgagctgcaaaagcttatcacggaaaaaggcacgagcggcgttcttcaagacatttgcggtattcagccgcatgaaccgctgcacggcatcgtgctcaaaaagctcaatcaataaaaatgaacccgcgtcggggggacgcgggttttttcttgcgttataatgagagggaagggaggctgcgtgatgaatcagacgctattgccccatcgttttccgtttcttttgattgacggcacgacgaacagtgaagccggaaaatgggcggctgcttacaaaaacatcagtgaaaatgactggtttataactgaatcccaaagagagatgccattttcgctcgtcgttgaagcaatggcccaaacggcggcttgcgcgggaattaccggcggtgacggcctcggtctcttatccgcggtgaagaaagcggaaaggttaggtgccgctttgccgggagaccgtctggatcttttttttgaggtcacacgaatcagacgcggttttgtgttcggccgggcgaaagcgtccgttgcgggaaagcctgtggcggatgccgagctcagcatatttatccagccatcgtaaaaaaagccgcctccaccggcggctttcggacaagcgtgttattttgtatcataatctctttcactttgtgaattgtccctttggtcatgtttgtgtttttcgtcattggcgttttccttcagctcttccagcggaatcggatcggttaaatcatgatgttcaggattttcattcggtttattcttttgttttctttctttcatcctccatcacctcaatatttattttcctcaacgctcgccctgccaaacgcaggaagcggttttttgttcctgtgggtcatatgtattaaaatagagacgactacaatataaaaagtgaggtacatatatgccgatacaaagagaagacgcagatattaaactgatcgcgattgatatggacggaaccctgctcaatgacgagcagctcatcccggaggaaaaccggcgggcgatcaaggaagcggaggcgaaaggaattcacgtcgtcatcagcacaggacgcacgctgatgacctgccgcgaactggctgagtctctcgagctgtcatcctttttaatcacggcaaacggcagcgaaatctgggattccaactttgagctggttgagcgcaagcttcttcataccgatcatattcaaaaattatgggatctgaggaataagcacaacacgaatttctgggcttccaccgtcgatagagtgtggagaggggaattcccggaaacgattacggatcatcagtggctcaagttcgggttcgaaatcgaggatgacgaagtgcggaatgaggtgctgaaagagctcaaagaatacaaggagctcgaaatcacaaactcaagtccgatcaacatcgaagtcaatgccctcggtatcaacaaagcggctgcgctggcgaaggtatcggaaaaactcggcttcacgatggaaaatgtgatggccatgggtgacagtctgaatgacattgccatgattgaaaaagcgggtgtcggcgtcgccatggggaacgcgcaggacatcgtgaaagaaacagctgactgggtgactgatgtcaacacggaaaacggggtcgccaaagcgatccgccactgggtgttataatagaaaaaagagagagtctcagcatgaggctctctttttttgttttgtcagatttgtgactaggtctatggtaggttttctgacaaaaggatgttcaaacctgtcagaattaaatataatgaagagaaattcaacaattcggaataatcgttccgaatatcggaatgataataaaataaaacgtttacaatacaggagggagcttatgtttcagattgacatcaattgtgatttaggagagagtttcggtgcttataaaatcggactggatgaagagattttggattatgtgacatctgcaaacatcgcctgcggctttcatgcgggtgatcccagcgtgatgcgcaaaacggttgcgcttgcggcggaaaaaggcgtgaaaatcggcgctcatcccgggctgttcgatctgcagggattcgggcggcggcagatcgcgattacgcccgaggaagcgtatgatctgacgctgtatcaaatcggcgcgctgtcagggtttttaaaagcggaaggtgtcgagatgcagcatgtgaagccgcacggcgctttatataatatggccgctgtcaatcccggcctgtcagaagccattgctcaggcgatctgtcattttgatcccggactcattcttttcgggctttccggaagcgagctgattaaagcgggagatcgaatcggactgaggacggcaagcgaagtgtttgcggaccgcacctatcaggaagacggcacgctgacgccgcgttcagagccggatgcgctgattcaggatgacaaaaaagcggtcggtcaagtgattcaaatggtgaaagacagcacggtgacatcacgtaagggacaagctgtaaacctgaaagcggacacggtctgcattcacggagacggcgcccacgcgctgacattcgcaaaaacaatcaaaaaagaattaaaagcggcagacattcaaatcagtgcgcttgcaaaagactgagcagcagagggaggaagacagcatggagcaaaagaaaaaaacagccggaaaggcttccggcaaatggtcgcttcttttaggcgcgacatttttgatggcgacatcatcaatcgggcccggctttctgacgcaaacggccacgtttaccaatacattggcggcaagcttcggctttatcattttaatctctattattttggacatcttcgcgcaaaccaatgtatggcggattatcgcggtttccggaaagcgcggccaagagattgccaatatggtgcttccgggcgccggttatgccattgcttttctggtcgtgctcggcggacttgcgtttaatatcggaaacatcggcggcgcgggtctcggtcttcaagtattattcggaatcaaaccggagatcggcgctttaatcagcgctgcgattgcggttctgattttcgtcataaaggaagccggaaaagtcatggaccgttttatgcagatcgccggaatcgtcatgatcgtattgacggtgtatgttgccgtaacgacggctccgccggtcggacacgccgttgtgaaaacttttatgcctgatcatatcagtgtgctggcaatcgtgacgcttgtcggcggcacggtcggcggatacattacatttgccggcggccaccgcttgcttgattcaggcatccaagggaaggaagtcattcctcaggtcacgaaaagctccatcacgggcgtcttgattacatctattatgcggattgccctgtttctcgccgtgctcggcgtcgtttcaaagggcctgcgcatcgatcctgataatcccgcggcttctgtgttcaagcttgcggcgggaaatgtcggctataaaattttcggcgtcatcatgtggtctgccgctatcacgtctgtcatcggcgccgcctatacatcggtgtcattcttcaaatcgttttcggcaaaaatcgaaaagcactcacatggcgtaattatcggttttatcattgtatccactcttatttttgtcacgatcggccagcctgccaaaattctggtcgcggtcggttcgcttaacggcttaattctgccgcttgcattagcgatgattctgttgggcgcttataagaaaaaaatcgtcggcgattacaagcatccgatctggctcacgattgcaggggcgatcgtagtggttgtcatggcggttatgggcatctatacattattctcgcaaatgccgcagctatggagctgatgatatgaaaaaccatatgagtgatacgagtcccgaagaagtcagacagcttatcaggaaagggcagatgaccgggccgacggcggggttggccgcttcttacgcacaagccaatctcgtcgttttgcaaaaggatcttgcctttgattttcttttattctgccagcgcaatcaaaagccttgtccggtgcttgatgtgacggatgcgggttcacctgttccggcaatagcggcgccgggagctgatatccggacggactttccgaaatacaggatttatcggcatggcgtgcttactgaagaggtaacggatattacgccgtattggaaggatgattatgtcgggtttttgatcggctgcagtttttcattcgagcaggcccttatcaatcagcacattccaatcaggcacatcgatgagggtgtgaatgtccccatgtataaaacaaatattgactgtgttccggcgggctcgttttcaggaaagatggtcgtcagcatgagaccgattccggaaaggcttgcagtccgcgcggcgcaggtcacgtcacgttttcccgccgtgcacggcgcccccgtccgcatcggaaatccgcaaagcatcggcatcagcgatttgcatcagccggatttcggagatgccgtaacggtgcgggaaggtgaagttcccgtattctgggcctgcggcgttacaccccaggcggtgatcatggaagcaaagcctgatatcgtaataacacattcaccggggcatatgctgatcaccgatatacgaaatgaatcgcttgctgtcctgtaagtgagaaagaatacaacgaggtgatgacaatgatgcagtatagcggaaatacagcgcttgatatacagccgtacggtgattccgccgttatcatccgctttggcgggcacatcagcgaagaggtcaacagccgggtgcatgcggcggcagcctgtatggaagaacggccgtttccgggcttcgttgaatgtattccggcattcacaagcttaacgatcttttatgacgtgtatgccgtctcaaacataaaaaaaggcgtctctccttttgccctggtcaagaaagaagtgacagaacgtctcagtcatataatgaccggccgcaaagaagagcgccgggtgatggaaatccccgtttgctacggcggtgatttcggtcccgatttagaagaggtcgctgagatgaacgatctgaccccggaagacgtcatccgcattcatactgaaggcgaatatctcgtttatatgctcggatttgcgccggggtttccgtttttaggaggaatgtctgagcggatcagagcgccgagaaaggcgtcgccaaggccgtccatcccggccggttcagtaggaatcgcgggaatgcagaccggtgtgtatccgatatccactcccggcggctggcagctgatcggcagcaccccgctccggcttttcaggccggaagaacatccgccgagtcttttgagagcgggcgatacggtgaaattcgtccggatcacagcagaggagtacagccgcatcaaggagggagccgaatgagtatgaaagtggtaaaacccggtctcttgacgacggttcaggacacgggacggacgggatatcaaaaatacggtgtattgggaagcggcgcaatggatacgatctctctgcgcatcgccaatcttcttgccggaaatcaagaaaaagaggcggggcttgaagttacgcttatggggccagggccttcctttgagttctcagaacccgcggttattgccgttacgggagcggatttcgcctttcatattaatggggagcccgcccctctgtggaaaccggttttgataaaggaaaacagcgtcgtctcattcgggccgtgcaagatggggagccgcgcttatctcgccgtcgcggggggatttgacgtgcccgccgtcatggaaagcaaaagcacgtatgtcagagcggggatcggcggcttttgcggaagagcgctgcaaaaagatgatgagctgccgctcggccgtatgacgccatgttcggaatcaatcgcgtaccgtctgagcgattctttcggacagcatggtttctcagcgcctgattggtctgtcagcagcagaggatttctgccgctgaaaaaaaatccggtcatacgagtgcttgaaggcgctcaatttcacgcttttacagaagaagcaaaattacgtttttatcaagagtcatatacggtcacgcctcaatccgaccgaatgggctaccggctgaagggcgctccgcttgaattgcgggagccgctggaaatggtatctgaggccgtgacgttcggaacggtgcaggtgccgccggacggcaatccgattattctgctggctgacagacagacgacggggggctatccgcggatggcgcatatcatatccgccgatcttcctctcgtcgcccaaacgatgccgggggaacacattacgttccgggccgtttcgctggaggaagcggaaatgctgcttttggagaaggaacagcagctgaaggagctgaaagcaaggctcaaaatggaatgggtgatctgacaaaggggctaaagaccatggaaaacaaaaacaagaccgtcatcaaatcaatggaactgcttcatttgtttctgactgaacagagcctgagcctaaatgagctggtttctctatcggaaatgccgaagacctcggttcaccggatggcaagctcactggaggaaacggggtttctcacccgggcggcggacggccgttatcagcttggtctgatctttttacaattcggccagctcgtctctgaacgtctggatatcaggaaaatagccaaaccgattatggaagagctgtgcggcgaagtggatgaggccgttcagctgatcatgagggacggggatgaagccatttacgtcgaaaaaattgaaggcacccaaaccgtccgcctgtatacggcaatcggccgccggtcgccgctgtacgcgggagcgtgcgccagaagcattttatcgtttctgccggaagaggagattgacacatacattcagaagacaaagcttgccgcaatcgcctcaggcacgatgacggatcgggctgaactgcttcactccattgaaagatccttgcaatcaggttatacgatcagctattcggaattagaagattatacggcggcgatcggggcgccgattttcaatcacgaaggtaaggtggctgccggaatcagcatcgccggcttcgaagcccggttttcagaggacaggctgccgtatttaaccgaaaaggtcaaaaacgccgcacagcatatttctgagaaattaggttattgaccgagccaatttttcttcactcgcgtacattacaatatcgatagtaacgagtggaggaaagtaaatgggacttgtttatacggcgctgggggattctttgacgacggggaggggatccgggccgttttccgccggttttgtccagcggttcgggcgcatgatggcagaagatttacagacaagaaccgacgtatccatctttgccaaatcaggccttgagacgggagaaattctcgggcttatgtccttgccgtacattcagaggcggattcaggctgctgatatgattacgattacaggctgcggcaacgatttgatcgattcggttcaggcatatcagcaaacatcggatgcttcggtattcaccagcgtgtccagtcactgccatgagaactttgaaaagatgatagccaagatcgctgccttaaaagggccgcacccgtctccttatgagatccgcgtcttcaatttatacaatcctttcccgggcatctccattgcagaaaaatggatatcctcttataatgcgcacctcagcacgctcgcatcggcgccgcacgtcaaaattgccgacgtccacagcgctttcaaaggaaaaatgaatgaatatctttctcatgaccgcgtacaccccaacagcaaggggtatgaagtcatggcatgcgtcctgcgggggctcggatacggaagcctcgcccgctcataaaccgcgcgctccttttcatggggagcgcgcttttcgtgctccttaaaacaaacttaaaattgtccgactttcgttctatccgcgcaaaaagtacgctagaataatgggggataaagacagaaatagaattgtgttcaaaaaatgataacagaaaggatggattgctttgctgcgcgccttaaaactgtcactcgcgatgctgattattatacttgcggccgccgcatttacgtatgcggaacatacctccgtcatacagccggttatgctcgtgtttctcggtgcggtcatgttcattcaggggctggaggaaaaacggaaagaaaacgacggctccgggaaattcaatatctataccgccgtttttgtatggtcgatctccttaatcggttttacgcttcacgcgatctgagtctgatagatcctgaaaatgctccacaacaggaaatggtgaataaaaacggtgcagtaaggctttccactcctgatattccggcgatccgcgaaagccttttgtatgatcttctaatgtctcccattccacaagcagcaaatatttatgcgtcttttccatacatttggacaaggaatgggacagataacctttcatgcccgcgataatcggctccgcccggcggaatgcctcttcgaattccccctcaaggccttcttttacatacagcatggctgcttctctgatcatctgagattcctcctttttttaatagatacattgtataagaatatgggccgtgacggccggaaaaacaaaaaaattttaaacgctctgagaaaaaaatccttgccagcctgatttggtttaggagaaaataacagttggaaggcaggggaatagacagtgaaaaaagggttatacctattacttttactcgcaggaatcataggtttgatcggctgctcgaaaacggaatcggccgaagacagaatgaaagatttcgtaaaagactggaacggcagtcattacgataagatgtaccaaagcctcacccaagatgaaaagaaaaaacgatccaaaaaggattttgtaaaacgatatgaaaccatttatgaacaagcaggggtcaaaaatctgaaagtcactgccgaaaaacaggacgaagacgataagaaaaaagatgacctccagcacatcgattataaagtcagcatggatacaaaagcagggaaggtcgcttttgaaaacacggccgtcctgaaaaaagagaaaacagacgatggcgaatcatggaacattgactggaatccttcttttattttcaaacagctttccgatgacaaaaccgtgcagatcgcaaatgaggaaccgaagcgcggacaaatttacgacaaagacggaaaaggtctcgccgtgaataccgaggtgccggaaatcggcattatccctggaaaactcggcaaggataaagacagcgtgatcaaaaaactgtctgaaaaactggacctttctgaagacgatatcaaaagcaaactgaaccagggctgggtaaaagacgactcctatgtcccgattcaaaaaatcagaccggatgatgaaagcaaggtcaaaagcctgctcgcactagacggcgtgacgaaaacgaaagtcagctcccgctactatccgtacggcgaaaaagcggcccatctgaccggctatattaaaaccatcacagcggagcagctgaaaaaagcgaaagacggccaatacagcgatacttccaaaatcggcatcgccggccttgagaatgtatatgaagacaagctgcgcggcacgaccggctggaaaatttacgtcccgcaaacaggtgaggtcattgctgaaaagaaagccgaaagcgggcgggatattcatgtaacgattgacatgaaaacgcagacgaagctgtatgattctatgaaagacgacagcggagcggcagtcgccctcgaaccgcaaacgggagagaccctcgcgctcgtcagcgcaccgtcttatgacccgaacggctttcttttcggctggagcggaaaagagtggaaaaagctgaatgaagataaaaacaatccgttttcagcgaaattcaacaaactttatgcgccgggatcaacgattaaaccgattgccgcggcagtcggcctgacaaacggcacattgaaagcgtcggaaaagaaaaaaatcaccggtaaagagtggcagaaagattcgagctggggcggttaccatgtcacacgcgtatcagagcgcctgaatgaagtggatctcgaaaacgcgctgatcacatcggacaacatctactttgcgcaaaatgccatagatgccggagcggacgcgtttacaaaaggattaaaaacatttggctttgatgaagagattccgtaccaatttccgattgaaaagtcctcaatcgctaacggcaagcttgattccgagatccttctcggagatacgggctacggccaggggcagatgctgatgtctcctctgcacttagcggctgactataccgcatttgtaacagacggaaatctcgtcaaaccgacattgatcaaagacggagaaaaaacaccgcaaatctggcataagcaagtggtgtcgaaagccaatgccgaagaaatcacaaaagggctgagaggcgtcgttgaagatccgcgcggctctgcatatcagccggccgtaagcggcattaccgtagccggaaaaaccggcacagccgagctgaaaacgtctaaagaagataaagacggcaaagaaaacggctggtttgtcggttacgattataaaaagaaagacctcttgatcgcgatgatgattcaagacgtcaaaaaacgcggcggaagccattacgtcgttgaaaaagcgaaaaagcagtttcagaatcattaaatgacgatttttgcgggctgaaaggaaaatcggccgccgaagcagaatgaaacagcatgggcaattcctgaaaacagagatacaagaggctctaagaaaaagggggatttcacatgcagcgcattcaattggctgaagacctggaattttcaagagtgatacacgggctttggcgtttgaacgaatggaatgtttcagacggagagctgctgaatctgattgaatggtgtatcagccaaggcatcaccaccttcgaccatgccgatatatacggcggttatacgtgtgaaaagctgttcggcggcgctttgtccctttcgccttcaataagggagcgaatcgaaatcgtcacaaaatgcgggattgtcattgaatcaccggagcggcccggaaacaagtcgcatcattataatacgtcgaagtctcacatcttagcgtcggcggagcagtcgcttttgaatctgaatacggattatctggatgtgctgctcattcacagaccggacccgcttatggacccggaggctgtggctgaagcgtttcacgcgctgaaaagctcgggcaaggtcagatatttcggggtatcgaactttaaagcgcaccagtacagaatgctcgaatcctatttggatgatccgctcatcacaaaccaaattgaaatctcggcgtacgagctggaaaatattcatgacggcacgctggatttctgtcaggaaaaacgcattccgccgatggcgtggtcaccgcttgcgggcgggagcgtctttacaggacaatcagataaggacctccgaatccgtgccgtgcttcgttccgtacaggaagaaatcggcgctgcttccattgacgaagtcatgtacgcatggctgttcacccacccggcagacatcatgccgattgtcggcagcggaaaagagaaccgcatttccgccgcggtgcgtgcatccgcgtacaaactcagccatgatcagtggttccggatttataccggtgtccaaggctgcgatattccataaacagaacaaacgcccggaaggtatcttccgggcgtttgtttatgtggtgtgcaatgtctaaaaacaagtaaggtcactttgaagtatagccgtgcggatcaagagtaacaagcgtcatggcatattatctgacacatttttctctttttcaatactgtcacacggcccagtgccaaattgccatttgaaaatggttgaataatcattgaaagcgttttatattataatttacaccactttccccggcagcactccccatatgccatacttctcacaactagaaaatctggaggcgcgtttcatgtatatgacagcgagagaacaaaaattaatgaaacatctattactgcagaaccgttacgagacagtgcatgaactggcagaagctttacaagtcagcacaagaaccgttcaccgcgagttaaaaacaatcaaaccgatgatggaatcattcggtctggcacttgataaacagcccggcaaaggactgaaagcggtaggaaacccggaggacaaacaaaaactcctgtcagacctgtcctatgaacagcatgaatacagcgctgaggagcggaaacttttaattctatgttcactattagagtcgcaagagccgatcaagctctacagtctggcgaacgaactgcaagtgacaaacgcgacgatcagctatgacctggatgagctggagacctggattgcgcccttcggcttgacgctgatccgaaaaaggggcttcggcattcagctgacggggccggaaaatgcgaaacggaaaatcgtcggcaatctcatcgtcaaccggcttgatattcagagctttttggaagcggttgaattcaatattaaaggaaaacctgacgatgctgaaaaaatgttcggcgtcgtaaataaagcggaacttttgaaaatggaccggctcttgattcagctcaaggaaaaaatcgcgatcgccttatctgacagctcatacatggcgcttgcggttcatttaacctttgcaatggaccggatcagactcggagaaaccatcacgatggaggcttcggaactaaaagcgctgcagcagacgaaggagtacggctctgcgctggaaatggcaaaagagcttgaaaaagcgttcggcgtttcaattccggaagctgagatcggttatatcaccattcatttgcggagcgccaaccgccaatacaaaacggaattcaaaccggaaaacattgaagttgaaacggccttgcaaacgaagcagctgatcggattcatttctgaaaaaatcaaaattgatctgacggaaaacggttctttatacgacggtttaatcgcccatctggagcctgcgatcaaccgggtgaaagaaaatatcgacatgtacaacccgatgaccgagcaaattaaacgcgactactttctgctgtacatggccgtagaagaaggaatggaaaaattctttccggggcttcttttctctgatgatgagatcgctttcatcgttcttcacttcggctccgctctggaaatcaaacgggaagaagcgaagatcaaggcgctgatcgtctgttccagcggcatcgggtcgtccaaaatgctcgcatccagactgaaaaaggagcttccggaaatccgttcctttgatatgtcttccctcatcgaactgaaggaccgagacatcaccgcgtatgacatgatcgtatccaccgttccgatcccgtatggaaacattgattacgtcatggtcagtccgcttttaaacgaagaagacgctgatcaggtgaagcagtacatcaaaagaaaaattccgctgattcttgacaaaaaaagaaacggtaaaagagaagagaagcagccggagacgcctgatatgctggaagcggccggccgtatggcacattatgcggcggttatccaaagcgtgctgcggaacttttcggtcaaatccattgagtcaaacacggcgtacgaactgtttttgaatcgtttgtttgccatgcttgagcaagaaggatttgtccgtaatgccaaacaaaccgcacagcgccttgcagagcgtgaacgacagggcggactcggcattccgggaacggcgatggcgctgtaccatctcaaaaatgaagaaattgtcacgccttttttcaaaatttatgatttgacggctccatgcagtgtcaaaggcatggacggaaattccctgaccgtcggccgcgctttggtgatgatggcgccggctgatatgcccgctgaagggtcggaaatactaagtgcggtcagctccgccatcatcgagtccgaagacagtataaaagccttccagacggaggatgaagccgatttatacaaacgtttaaacaagctgttttatcatttcattcaggagaaaggacagcggtaaacagaaagcgcacacctcatatggggtgtgtttttttctgcatgtatgagggtaaggggaagggaagaaactaaaaacatgggactattgtatcattcacgaatggaatagttctaaaacaaaattgttttacaagttatattttttggtttaaaatgggttgcgtgaggaagaaaatctgacagagttttttgtgatttatgattatgggagatgaaaatatggagacattacagcatctgattctgcatgacatttcaaatagcgaagagatcgaagctgtaaaaagcggtgcgcataccctgacctacgcggaatatcgaaaacgaatcaaccagcttgcacaagcgcttcttgataaaggaataaaaaaaggcgacagagtggcgatgctttgcaaaaacggccacgcgtcatccattgtcatgtttgcggcactcgaaatcggcgcggttgttgtgccggtcagctggcaattaacaccttacgaaatgaaaggcattttagcagcctgtgaaccgaaagctgtctttttcggcactgaatttaaagagattatggaagaagttcttcctgcgctggtatcttctcttaaactgaaggtcgagacaggaacagctgcggagacaacgcctgagtttgacgctttattgacaggctccggtgatacaccggatgtcgaaacggtgtctgaaaacgatacggcattgctgatgtttacttcaggtacaaccggcaatccgaaacgctgcatgatcactcacggcggcatatacaactacgtaaacgcgacattggcttacacggggagaatgcagcatgtccgcttcttagcatgccatccgaattaccatacgagcgcgattatctgccagatggtcggcacgatgagcggaacgacattcattatgacagacaatcaggaccctgtggaaaacttgaagctcatcgaaaaagaaaaaattcaaaccatcatggcgctgccagtctatttcacatacctgctgaaagcatgggaaacgcaccagactgacatgtcttctatcgtttatatgatgacgggaggcacaaaggtgccaagcagcctgatccagcagtatctcgacatcggcatcccgctcatgcacggatacggaagcacggaagcgtggggcatcagctcttggaatccgcaaatgggaatggataaagccgcttccgcgggtaaaccgatggaagaagtggacgtccgcgttgtagatccggaaacaggtgaagtccttccgcaaggctcaatcggagaagtcgttgtgacaagtccgtttttattcaaaggctacgaaggtaatgaagaagcgacacgaaaagtgctgaaagacggctggttccataccggcgattccggctatgtggatgaagacggatttatttttatcaccggacgttataaagatgtcatcatctacggcggcgataatatttatcccgaccagattgaagaagtcattcagcaagtgccgggcattctcgaaacggcggttgtcggtatccctgatccgctttacggcgaaaagccgaaagcgttcatcgtgacaaacggcagagaagacctgacagaagaagaagtgacccgattcctgcaagaacgtcttgctgcctttaaaattccggacattgagttcgtcagcgaacttccgaaaaacaaccttggaaaagtgagaaaagacgtgctccgcaaacaagcggtacgttcataatagagaacaaaaacccggctgccagccgggtttttttcttgcgttccatgtgaaacatttttctccgaaaacgttttgaactgtctcaatcatgtttatccggaggacagccgaggtagacaagaaatatgagatcgaacaagaaggaggaacttgacatggaaaactatccgaaggaattcccggcggaatcacaaaaccgccagccgggcattgaaaacgaaatgaatccggcgcctgtttacgaatacaaagaatataaaggcgctgacaaattaaaagggaaaaccgcgctcattacagggggcgacagcggtatcggacgcgccgttgcggttgcttacgcgaaggaaggcgcaaatgtcgcgatcgtctattttgatgaacacggtgatgcggaagatacaaaaaaacgagtggaagaagaaggcgtaaaatgtctgttaatccccggcgatgtcggtgaggaagacttttgcaatgaatccgttgaaaaaacggttgaagaattcgggcgtcttgatattctcgtgaataacgccgcggaacagcatccgaaagaaagcattaaagacatcacaagcgagcagcttcacagaacctttaagacaaacttttactcacaattttatttgactaaaaaagcgattgattacatgaagccgggcagcgcgatcatcaatacgacatccattaatccttacacaggcaatccgcagctgattgactacacggctacgaaaggcgcgattaacggttttacgagatccatggcgcaagcgctcgtcaacgatggtatccgtgtcaacgccgtggcgccggggccgatctggacaccgcttattccggcgacattctcagaagaaacagtcgcttccttcggtcaggatacgccgatgggccgggcaggccagcctgttgagcatgtcggatgctatgtgctcttggcctcagacgaatcctcttatatgaccggacagacgctgcatgtcaacggcggcagatttgtgaccacataaggaggcagacccatgacgatatcgaagcatgacgtgaatgcatactatcaaaaagcgggaatcgttctgactgatgatgaagttgaagacattcaaatcatggattacggcttaggcaagcttgaggaaaccgggcttcagctgtttatttacgtgaataccgaccgctactgttcgaaagaattggtgctcttcccgcgccagacgtgtccggaacaccgccatccgccggtaggcggcgagaagggaaaacaagagacattccgctgccgctgggggaaggtgtatctctacgtggaaggcgaaaagacagagaacccaagcgtcctcccgccggaagaagacaaggagtactacaccgtctggcatgagattgtgcttgagccgggcggacaatacaccattccgccggatacgaagcattggtttcaagcgggagaggaaggggcggtcgttacggaaatgtcatcgacaagcacggatgatcacgatgttttcaccgacccgcgcatttaaggatgaggctgcacgcctcatcttttttgtatggaaaaaaataaatttacctgtataatggctaataaaggaaagaaggtgcggtcgtgttttcctgtcaaatccgggaacatctgacgatcagattgcttgccaaagaagatacggacgaattgtattctgttatgaagcgaaatcaaaaccatctcagcgaatggctcagctgggcggaagaactggctgacatcgatacgtaccgcgatgtgatcatccccgaatggcgctataaatatgcggaagagaatgggtttgacgccggaatttttgtgaaaggccggttttgcggcatgatcagcatccataatgtcgatacagtcaatcaaaaagcagagatcggctactggctggatcgagagcatgaaggattcggcattatcaccgcaagctgccgggcggtcatcacccatgcatttcaggacctcgggctgaaccgcatcatgatcagcgcggctgaaaaaaacacgaaaagcagggcggtggcggaacggctcggatttcagaaagaaggactgacgagagaaggcattttcgtacagggcgcctatcatgacacggtgaactacagcatgctgaagcgggaatggagcgaagatcggcagaagagcacatttcttggtttaaatgtctccccaatgtggaaaagtaacagcggagacgttaaaaaggagtgattcttcatgaatcaaaatgaaatcaaagaaaaagtgcttgaagtactggatcatcataaagtcggttcgcttgcgacggtagagcaaggcaaaccgcattcacgctacatgacatttttccatgacggcttaacgatttacacgccgacgagcaaagacactcataaagcggaagaaattgaaaacaatccgaatgttcatattctgttagggtatgactgtgaaggattcggtgacgcttatgtggaagtggccggaaccgccaaactgaacaactcagcagatttaaaagaaaagctgtgggatccgaaactggaacgctggtttgacggaaaagacgatccgaacctggtgattcttgaaattgaaccgaagcagatcaagctcatgaacgcgggtgaaaaaacgccggccgagctggaactttaataaatcatttgattattcaggggcaatctgttatacttaactgctaagtgacaacatgcaaataaaaaagaaagtaaacttcttttttctgttttgatatagaagcttcaggcttcaacggacagcttgaaaaaaagctgagcttattcttttccttctgatattcgcccctaacgaagagatggaaaaaagactttttgttttacaattcacaccggcgcggcttcggagccgcagtgacgattgagaggtagggctttcgttgtcttgtgttcaagaacttccatggtgtttactttcgaagaatgattctgtcggaactgttaatacgaatcacccgcgggctaaggcgggcaaccatatattatttatttgcgtaagaaaagaataagacaaaaccgcgccggacatccgggcggtttttttatgtaaacggccgaaacctcgccgcagtctgcagagtctaatcagtatgaaaagatttggaggaatcatacattgcacgttattacttcacaagtactgtttatcttctgttttctgctgctgatacattcgattgaaacgcttgcctatgcaacacggctttccggcgcgagagtcggatttatcgcgtccgcgctgtcattatttaatgtcatggttattgtgtcgcgcatgtcaaacatggttcagcagccgtttaccggacatctgattgatgccgccggatcaaacgctctgtctgttgtgggcgcccagtttcgatttttaatattcggctccacggtcggaacgatgctcggcatctgtcttctgccgacattcgtcgcgttattctccagggcgattatacacttggcggacggaggaggctccgtcatgcaggtatttaaaaaaggattttcactgaacgggctgaagcatgcgcgttcttatatcagactgccgtcagtctcctatttaaaggggcttcaattccgaatgatcccgaaacgcttgtttgtcattaatatggtcattacgtctatttacacgatcggcgttctgtccgctctgtacgccggccttctggcgcctgagcacagtacgaccgccgtgatggcatcaggcttaatcaacggcgttgcgactatgctgctggccgtgtttgttgacccgaaagtctccgtactggcagacgatgtggcgaagggcaagcgcagctacgtctccttaaaatggacatcattgacgatggtcacatcaagggtcgcgggcacgcttctcgcccagctcgtattcctccccggcgcttattatatcgcctgggtgacgaaatggatgtaacgcatgaaaaaagctcctctgcagaagaggagcttttttattgataatttctcaggccgcgatcataaataaaattaccgaacggaataaaggccgcgataaaaccggcggctgaccatttcacatgccatttgacagtaaatgccgcatacgccagcaccgccagataaatgataaacaaaccgccgtgaatggaaccggcaatggtgacggcgagcggatgatgagcccaatacttcagcggcatcgcgataaacagcagcaccaaaagtgacattccttcaataaaccccatcgtgcgaagtctgccgatcggcgtgtgtaacatacagctccctcctgtcggacatcttttttcctctatactataagcaaagggcagtcctaatatgaccatttcgcgtcagttcctgaaaaaaccttcatgatttcagcctgttgttcttgtcatttttcggatttctcttgataatatagccaaaagggtaaggaaggactacagtcatgaaactagataatgtggatctgagcatcattaaagagctgcagcgggacagccgcctgtccatgcgggagctgggcagaaaaatcaaattgtcagccccgtccgtcacagagcgtgtcagacagcttgaatccttcggcgttattaagcgctatacattggacattgatcaaaaaaagatcgggctccccgtctcctgcattgtcgaagcgacggtgaaaaacggaaaatacgatcaattcaaaacctacattcaatccattcccaacattgaattttgttttcgggtcgccggggcggcgtgttatatgctgaagattaacgcggacagcctggaaacgatcgaacacttcatcaaccgcacctctccgtatgcccaaaccgtgacccacgtcattttctcagaaattgacacaaaaaacgtcctcgattagagagagcgtgaggaagtctgttataataacaggatgagtgtgaaagaaagagaagtgaaaagcatgtcaaaaacagttgtattagctgaaaaaccttcagtcggccgggacttggcccgcgttctgaagtgtcataaaaaaggaaacggatatcttgaaggcgaccgctacatcgtcacatgggcgctcgggcatctggtaacgctcgctgaccctgaaggatacggcaaagaatttcaatcatggcggcttgaggatcttccgattattccggagcctttaaagctcgtcgtcattaaaaaaacaggaaaacagttcaatgcggtcaaagctcagcttgtccggaaagacgtcagccagatcgtaatcgctacagacgcaggacgggaaggggaacttgtggcccgctggattatcgaaaaggcaaacgtccgcaaaccgattaagcggctgtggatttcctctgtgacggataaggcgattaaagaaggatttcaaaagctccgcagcggcaaagagtacgaaaacctgtatcattccgccgttgccagagcggaagcggattggattgtcggcatcaacgcgacccgcgccctgaccacgaaatttaacgcgcagctgtcatgcggacgcgtccagactccgacactggcgatgatcgccaaacgcgaagcggatattcaggcgttcaaacccgttccttattacggtctccgcgcggcggctgatcagatgacgctgacatggcaggataaaaaaacaaagcagacaagaacgttcgatcagacggtgaccggccgtttggcaaaagacctgcaaggaaagccggcagtcatttcagaattgaaaaaaacggcgaagaaaagcttcgctcccggtctttacgacttgacggaattgcagcgggacgctcataagcgcttcggtttctccgcaaaagagacgctgtccgtgcttcaaaagctgtatgaacagcataagcttgtcacttacccgcggacggattccagattcctttccgcagacatcgtgccgactttaaaagaccgtttaaacggcatggaagttaagccgtacgcccagtacgtcaatcaaatactgaagcggggcgtcaaagcgcataaaggattcgtcaatgatgcgaaagtatcggatcaccatgccatcattccgacagaggagccgctgatcctttcaagcctcagcgacaaagaacgaaagctttacgatctgattgccaaacgttttctcgccgtgttaatgccggcgttcgaatacgaagaaacaaaggtcacagccgatatcggcggcgaaacatttaccgcaaaagggaaaacggttcaatcgcctggctggaaagccgtgtatgatatgtacgaggatgacgacgatcatgaggaagacaaagaccagacgctcccggatcttcagcagggtcagcgcctcactgtctcatcattgaaagaaacgagcggacagacgaaaccgccggcgcgctttaatgaaggcacgctgttatccgcgatggagaacccaagcgcctttatgcagggagaagagaagaaccttgtgaaaacattgggtgaaaccggcggactcggaacagtcgccacccgcgctgatatcattgaaaaactgttcaacagtttcttgatcgagaaaaaagaaaaagatattttcattacgtcaaaagggaagcagctcttacagctcgtcccggaagatttaaaatcgccggccttaaccgctgagtgggagcaaaagctctccgccatcgcagcgggcaaactgaaatccgccgtgttcattaaagacatgaaaacatatgcgggcaaaacggtgaaggaaatcaaaaacagcagccagactttcagacatgacaacatttcaggcaccgcctgccctgattgcggcaaaatgatgcttaaagtcaacggcaaacgcggcacgatgctcgtatgtcaggatcgtgagtgcggcagccggaaaacgctggcaagaaaaacaaacgcccgctgtccgaactgtcataagaaaatggagcttcgcggccagggcgaaggccaaaccttcgcatgtgtatgcggccaccgggagaaactgtccgtctttgaaaagcgcaaggcgaaagataaatccggccgcgcatccaagcgggacatcaactcttatatgaaaagccaaaacaaagaggagccgatgaacaacgcgctggcagaacagctgaaaaaactcggcctggataaatagatcagagaaaggcagcatttgtaaagaaatgctgccttttgttgtgttttttactgtaatgggaatacgatccagacgaagagggaaaaggtgagaggcggcgctcccatttaaaattttccaatgtgaaaaaatgctagtattcttttatcgtttcctttatagtaaaaatactttgtgaaaaaataagatatgggtctaaaaaaggatttataaaataggaggatgggctgtgaagcaattcgtttttcgtctgatgctccttttgattccgatcgttctgacggcggggtgcgcggaggccggcactgaaaaacaggcggcagccgaaccgtccggaccgcttcagcccgcagagcattttatttatcataaattgatgaacgggcgggggatgatccggacgaacatatccggtgagccggaatatttatctgagtctctcggactatggatggcatttttgctgaacaggaaagatgaacggcagtttcaagcgcaatatcagcttctcaccgattcgtttctgacgaaaaacgggctcgtgtcgtggaagattgacgggaataaagcgagcggcaccaatgccttaattgacgatttcagaatcatgaactgtctgaatgaggccggaaccctgtggagaaacagtgaatacgggaaaacagcggtgcagatcgggaaggcgctggaaaaatacaatacgaatgacgggtattttacggattattatgatgccgcttcaaatgccgcatcaaagaccgtgacgttatcctatgttgaccccggcgccttacagatgctcagagaaaaagggattatcgatgagaaaacggaaaaccggaaccttgatgttctcaatcatgcgcccctgaaaaatggttttctgccgaaatcattcaataccgaaacaaaggaatacaaatatgacagcgaagtgaatgtcatcgaccagctgtacgccgccgtgaatctgaagcggggcgatggcaaggctgccgcgctgtcaaaatggatgatagaggaatttaagtcgcgcggacagctgtacggacgatacagcgcagacacgaaggagccggcggttcagtacgaatcaccgtccgtttacgccctggccgttctttttttagcagaacaaaaagctgatccggctgtcatcaagccgctttatgaaagaatgacttcatttgaaacactggacacgctgaaacccgattacggcggctatatgagcgggagcgatacacattctttcgataacctgctgccgcttctggctgaaaggaaattgtttaatgaaaatatcattcaatgaatcacaaaaactgtgcagctacacagcagttatgctggtgctgctgtctttttttatttactatgcgtctcagcaatccgcagggcttctgataacctgcatcacattgcttgttgcgggagccggtatatggttcggggcaatttacgcgctcgtcatgaccttactcgtcttatttgttctcggcagcctgctcctgtggtttcagaccgggagctttatggcgtctgccggtgccgaaagtctgcaggtgctggtcatttgggggattgcgctgctgctcttttcttacatagcgggaaggattcacgagttggcgaaggggcttgagcgctcagtgaaacagctgcgtgaagagattacgagctttgtcgccgtcgacagggtgaccggctttgacaaccatctgcggatgaagctggagctttccgaagagatcaagcgggcggaacgctacggcaattccttcgtctttttgctgctgcacatgcattatttcaaggaatttaaatccctgtacggagaaaaagagaccgatcggctgctggcgtttatcagccgccaaatccggtcaagcgttcgggaaacagacaaaaaattcaggccgtccgccgaacggttcggcatcgtgctgacccatacgcctgaagaaaacatgccggccgttctggcgaagctgaaaaaggaattggatacgtaccggctgcaaaacggtaaatacgtctccatcaccttccgtgtatgttacttggcgtaccgaaaagatttacaaacggccgagcaatttttaaacgaactggaaaacgagatgatgatgaatgaactctaaatggatacgtctcttactctcggcgctcttcatgatttcggcggtttatgttccccgtccggcggaagcaaaagacaaaaaggacggcattctcattatttatacaagcacggacggcaaagaaaccgctgaggtcaaaatgcttgatctgaccgcgggccatttctcatcagccgtcaccgtgaaaagcgacggagacatcacagccgcggacttcaaaaagaatcggcgcgtcatctattacggcgtcacgaaaaaaaagctcagcacatcatttgtgtcactgatcagcagcatgccgcagcagcttatcagcatcggctataacgccggacagttccgccaatttgcggggttgtccctgacagaaaaagaaacggtataccgcatttacagcaagaaagaaaaaacagacatgccgcttgaaaaagggatgtccgtgctcggcgtatcgggagtaaaaggaaagtccctttatacataccggtccggtgacggcagcacccgcccttttatgtggaaaacggcgcgctctgactattatttcggtgtgacgagcctgttaaatgattcgtttctgacggcgaaagcgatgcgcaacgcattcggagaatcagagggcggcaccctcctttatttgcggcttgaagacatcagtccgatgtcagatgaaacattgctttacgaagcgggcgcttacctgcataaaagacacattccgtttattctggcggtcattccggtctatctcaatccggaaaacggagaaaaagtatacctggcggacaagccgaaaatggtccgcgtcctgaaaaaacttcagcaaatgggcggcagcatcattattcacggctacacgcacgcataccgatacagcgaaacgggagaaggctttgaattttgggatgccaaagcggatcagccgattacgtcagaaaatgcggataatactccggtcaagcttgaaaaggaacaggattttccgaatgaaaaagcgtaccgggcgtatgtgaaaccttttcgtgaaaaagaaaacatctacacgagaacgaagctggagcaggcgattgacgatctgacagagctcggcctttacccgctgtcattcgaagcgccgcactacacgatgtctgaagaaggctacaaaatcgcatcttcttatttctccagtattttcggacaagtgcagctcagcggcacgacgtggaaaacctcgggcgcccctccgttcgtctcaaagccggctatgctggacgggatgacgctgtaccctgaaacaatcggttatgccgataactcaaaggaaaatccgctcggagatatggagaatcatatctcgcagatgattgatttcggcggcggaacggcgggcggtttctaccatccgtatctcggcatgaaataccttcccgagctcgtcaatcagatggagcggattcccggcggcgagtggctcgatctgaagaaaacgaagcaaacggtaacgtcggacagcgtcaggatcaaaacggacggagacggaaccattcatgtggaaaacaagattcatccgataacggcctttttcaatcaccatcagcagacgcctctggaaaaagcgctttggattctctccggcgtggtgttattgtttatcatcatgttcgcctgctacgtcctttatttgcgcgccacattaaaaaaacgaatctttaaggagagaagaagccttgagtaacattctgttttttatctcattaagtttaatatgggtgatgcttctctatcacatgtttctgatgcagggcggattcaggcattatatgaccttcgaacggaacattccgaaatggcgcgcaaagatgggggagctcccgaaggtcagcgtgctcattcccgcgcataacgaggaggtcgtcatcaggcagacgctgaaggcgatggtgaacctgtattatccgaaagacaggcttgagatcattgtcgttaatgataattcctccgaccggacgggagatatcgtcaatgaattttcccgtcagtatgacttcattaaaatggttatcacaaagcccccgaacgccggaaaaggaaaatcttcggcgctgaactcagggttcgcggaatcgaacggagacgtgatctgcgtgtatgatgcggacaatacgccggaaaaaatggcggtgtactacctggttctcggtctgatgaatgatgagaaagcgggagcggttgtcgggaaattccgtgttatcaatgcggcgaaaacgatcctgacgaagtttatcaatattgaaaccatctgttttcagtggatggcgcagggcggcagatggaaatggttcaaaatcgccaccatcccgggaacgaacttcgcgatcaggcggagcattatcgaacagctcggcggctgggatgataaggcgctggcggaggataccgagctgaccatccgcgtgtataatctcggctatcatatccgctttttcccggcggctgtgacatgggagcaggagcctgagacatggaaggtctggtggcgtcagcggacaagatgggcgcgcggcaaccagtacgtcgttcttaagtttttatcccaatttttcaagctgaaacgcaagcggatcatcttcgatctgttttatttcttttttacgtattttttgtttttcttcggtgtgatcatgtcaaacacgatttttatcatcaatcttttttacgacctgcatctgacagtcgggtttttggcgatgattttgtggatactggcctttttcctgtttatgactgaggtcatgattactttgagcattgaaaaaacagaaatgaacaaacaaaacttctttatcgtatttctgatgtactttacatactcccaggcttggatcgtgctcgtcatctggtcattattcacagagatcaagcaccgattgttcaagcaggaagtcaagtggtacaaaacggagcgatacaatcaaaataaaagcgggtgacctttttgaaaaaagcgatcatattgataactggccttttgctattgatgtataacgggcaggcggccgcggcccgggaactgaaaacggacggttccgccctcggaacaagcgccggcgcaaaagagcagcaggcgctgactggcgatctgatgacactgtacggggcgaaagacagctcagagctgacctatcagattcctgcgggagcttcgaatgccgatcagtcgcttctgattgattacgaggcgtcaaacttattaattgccccgtcttctttaaccatcgccattgatgatgaacccgtcaaatccataaagcttgacggcagctccaagcggaaaacggtgaagctcaatctcagcaaaagccaatccgcccaaggctatcacaatgtatcattacgattttacggcgtattaaaagagggcgtctgcgtcaggcaggatacgtcaggcaactggataaaaatttatccggacagccgccttgtgctttcagaagcaagcaagtcaaagggagcggatctcggccatttcccgtatccgtttgcccaatcaggcaatacgggtgaagaaaccgatattatccttcctgacaaaccgacctctgctgaagctgaagccgcagtcaaaacagaaggatttctgaaaacggctgacagcaggctgaaggtatcctatgtaaaagaatccgacgccggcaaaatcagcaatccgtcaattgtcatcggcgctgatcagcattggaacgggaaaataaaagagcttttcgatcgcgggaacctcaaagcggaagacaacaaactccttctcgctgaacgggttctgacatcaggggacaaacggcagcccgtcctgtttgtcacggcgcactcagacaaaacgctggcggataaaatccgcgtcatcacagacagcgcttattcaagccagctgggcggagatactttgacaatcggccgccttcagcccgctgcggaaaaaacaggcaataaactgacattagaggacttcggcgcgggaaatgtaacggtcggatcaaacaaaacggcgtcagagcacttcttttaccctgcggcggccgctgttgataaagacggtaaggttaagctttcacttacattaaaaacgtcggaatcgatccggacgaaggcggattcagctaatgacgccgagagagcggagctgaacgtcatggtcaacggacagccgaatgcggtgcgtcttgacgatctcggcaatcaagataaagacggcttttaccacgtctcaatcccgattgatccgaagcttttgcgaagcagcaggtacattgatctgcaatttgtcacgtcaggtttgaaacataacaacccgtgtatcgaccgtgacgaaaataaatgggtctatattgataaaagcagcatgctgacgtatccggtaagtgatgcggcgcagaaagcggatttcgggcaatggccgctcccgtttgcgggcggcgtgaaagagaaaacagtgatcgtcatcccggatgacgtaaacatacagacactgaaagaactttctctggtggcggattcattcggaaacggctttaccgtaaagacggcatcagacatgaaggaagcggatgccaaaggccggaatgttgtgtttatcggaggcctgccgcaaattccgcttttgaaatcaaacgcctctaagcttctcgtgccgtcagaccgcagcggcgcgtacgatgtttcttcgtttcaaatgctgaatgagacaacgaaacaagtcgcgtttacccaggaatcaccttgggactccggccggagcatcgctgtttttgctccgttatcaggcagcggcgcgtctgtcacaaaagagctgatccgctttttagacagcacaagcgatgccgcaaccgtcattaacgaaacggccggccggcagctgttttcaaaccatcagcaaatcaaatccgacgacagcagtccatcgcctgatacgaaaagccgttccgcagcactgaacgtcacgtatatcgctgttttcgctgcgcttataattattgcggccggtctgatctggctgacggcaagaaggaaaaaaagaaaagcggacaatgaaaaaagtgaagagtaatgaaggaaaaagaggccgttaacaggcctctttttttgtatttttatttccatttttggcggtgatttttttatttttgaaacagcataaaagcccctttacaactgaacgggacgggagtatgatctcttttataatctatatcgcttaatctgtaatcagagcgggggaaccaatttgcggcgcgtcatgccgcttggggtgaatcctttttcaggtagggccaactctcatcagcccgaatccgacagctaacctcgtaagcgttcatgagaggagatgaatgaaacctgtgcacgattatggcgcaggggcatccgtttgcctctgtgtctttttgctgtgccgaaatatggcatgcaatcgttattcagagacatcatagcagtaagggtttgtaaatcaaacggaaaatgaaaaaaaggggaagacaaaaaatgtaccattcaatcaaaagatttttgattgggaaaccgctgaaatcacaggcggccggagagcagaaactcacgaaactcaaggcgctcgccatgctttcttcagacgcgctgtcatcagttgcttacggaacggaacagattctgatcattttggctgcggtaagcgcggccgcgttttggtattccattccgatcgcagcgggtgttctcattttgctgcttgctttgattctgtcctacagacagattatttacgcttatccgcaaggcgggggcgcttatatggtgtcaaaagaaaaccttggtgagaagccgggcctgattgcggggggctcattgcttgttgattatattctgactgttgcggtaagcatttctgccggaactgatgcgattacatcggcatttccggctttgcacccgtatcatttgctcattgctgttttgcttgtgattctgattatgattttaaatttgagagggctgtcagagtcggcgtccattttggcgtatcccgtctatctgtttgtggcggcgcttgtccttttgatcgtcgtcgggctgtttaagctcatgacggggcaggttcatccggccgagcatacaccgatcggcacgcccgtagcgggcatcacgctgtttttgctgctgaaggccttttcatccggctgctcggcactgaccggtgttgaagccatttcaaacgcgatcccggcctttaaaaatcctccggcgaaaaacgcggcccgcactttggccatgatggggattctgctggcgatcttatttacggggattacggtgctggcgtacggctacggtacgggtccgaagcctaacgagaccgttatttcacaaatcgcagcggaaactttcggacggcatacggtgtactatttcattcaaggcgttacatccctgattctcgtgcttgcggcaaatacgggcttttctgcttttccgcagctggcgtttaatttagcgcgcgatcagtatatgccgagaatgtttacggtacgaggcgaccgattaggattttcaaacggaatcatctttctcggtatcgcgtccatcttgctcattcttttattcggcggccgcacggaacatttaattccgctttatgccgtcggcgtgttcattccgtttacgctgtcgcagacgggaatgtgcatcaagtggatcaggcagaagccgaagggctgggcggtaaaaatgctgatcaactcatgcggcgccgccatttcatttatggtgctgtgtattttattcgcgacgaagttcaatcttgtctggccggtgctgttattcatgcctgctgtcgtcatgctgtttttcgtcattaaaaatcactacaccgcggtcggcgaacagctgcgagtcgttgatcagcagcctgaggaaatcaagggaaccgtcgtcatcgtgcctgtcgccggtgtcaccaccgtcgtccaaaaatcgattcagtatgcgaaatcattatcggatcaggtcattgcggtccatgtttcctttgacagagaacacgaaaaaaaggtggaaaagcgctgggaagagcttcataacggcgtccgcctcgtcaccctgcattcctcataccgcagtctggttcacccgtttgataagtttttagaaacggtcgaacaaaaagcgaaaaaagaacagttctccgtgatggtgctgtttccgcaatttattacgaaaaaacgctggcagaccatccttcacaaccaatcagccttcttgctccgcgtccggctgttttggaagaaggacatcattgtcgccaccctgccgtatcattttaaaaagtaacggtaaagaccgcaggctaaaatgccgcggtcttttttgtaaaggaggacgacatggcacaaggcgcgtttgtcatcatacaaaatgaggagcgggacatattgctcgtaaaacgaaaagacattcccttatgggatttgcccgggggcaggatcgcagaaggtgaaatacctgaagccgcagccgtcagagaggccttcgaagaaaccggttataacgtgaccatcctgcataaagccggtgagtatgaaaggccggcatttgaagatacacagcatgtattcatcggagccattaccggaggaacaccgctgatgaacgggccggaaaccgccgcattacgctggttttccccaaaccggctgccgctgttcatggtgccgaacagaaaacggcagataaaagacggactcaatggggcggcaaatcgtaaggcagtccttaaagacctaaatctgttatccatccttgatcttctgagaaaaaagctgagagtatagcccgtgtttcaacccgtatgaaaaaggggatgaatacaggtaaaaggaggatgcagtatgccaagtaaaacagcaggacacgtaatgacggagctgcttgaacaatggggagtcggtcatatatacggcattcccggagacagcattaatgaatttatcgaagaactgagacatgaacaaaataacctgacattcatccaaacccggcacgaggaagtcgccgccctggctgccgcggctgaggcaaaactgaccggacagatcggtgtctgcctttcaatcgcaggaccgggggccgttcatctgctgaacggtttatacgacgccaaagcggacggcgttccggtgctggcgattgcgggacaggtggcttccgatgaaatcgggcgtgacagctttcaggaaatcaaattagagcaaatgtttgaggacgtggcggtattcaaccagcaagtacatacggcagaagcgctgcccgatcttctgaatcaggcgatccgcacggcttacagcaaaaaaggcgttgccgttttaaccgtttctgatgatttattcgcgcaaaaaatcaaacgggagccggtttacacatcgccgatatacctcaaagccgatatagagccgaaaaaagaacatctcgtcacatgcgcgcaatatattaacaacgcaaaaaaaccggtcattctcgccggccaagggttaaaatcggcaaaagaggagctgctcgcattcgccgataaagcggccgccccgattgtcattacccttccggcaaaaggcgtcgtgcctgacagccatccacactttctcgggaatctcgggcaaatcggcacaaagcccgcctacgaagccatggaggaatgcgatctgctgatcatgctcggcacatcgttcccatacagggattatctcccggacgatacgcctgccattcagcttgattcggatccggcgaaaatcggcaagcgctatcccgtcaatgcgggaatcgtcagtgatgcggctctggggctgaaagagctgacggaatacattgaatataaagaagacagaagatttttagacgcctgcaccgagcacatgaagcattggtggaaggaaatcgagaaggatgaaaccgaagcgactcatccgctcaagccgcagcaggtcattgcccggcttcaggatgccgccgcagaggacgccgtcctgtcagtggatgtcggaacggttacggtgtggatggcccgccattttaaaatgaagaagcaggactttatcgtctcaagctggctcgccacaatgggatgcgggcttccgggagcgattgccgcaagccttgccgaacctgagcggcagtccatcgccatttgcggagacggcggattttcaatggtgatgcaggatctgccgacggctgttaaatataaactgccgattacggttgtcatattaaacaacgaaaatttaggcatgattgaatatgaacagcgggtcaaaggcaacattgactacgtcacccagctgcaaaatatggattacgccgcttttgcagaaagctgcggagcaaaaggcatcaaagtgacgaaacacgaggaattggctcccgcttttcatgaagcgctcaactcaaatgagccggtcgtcatcgacgccgtcatcggcgacgagccgccgcttccgggaaaaatcacttacggccaagcgaagggcttcagcaaatacatgctgaaaaacttctttgaaaaccaaaaaatcgaaatgccgtcactcaagaaaagcttaaaacggctgttttaagaagccagcgcttataaaaaataaacaggcagcatgcctgtttatttttttaggctttcttgttgatgattatttctttaatgacctcttccatggtaaggaagtggtcagcagtttgaacccgcttggaagcttagaggacggggaccgcaatcgaaagtgtatcgtattaaaatctggcgaaacggtaaaggagatcgtaaaattcgcagctggcgagcgatggctgatcaaaaaactcgtgatggatcagcgcggtttcatctgaagaacagccagagagcggtcacaacagcgatcataaagtaatctccatcattcagtgtagttccatttttgacaaacatacgtgccgtccggtttgtctttgtcccttccggggttttaagcgcaatgttcttccctatattgtaataaacaactttaaacaaataatatgccagcgaacagaataaaaagagcaacatgaacttgccaataaacaatatcatgtttcattactcccttttgccgttttttcgtttgaatatatgacggagaagtcaggatgttatataaaaggagaagtattttacagaggccggtgttaaacattaatgaacggttcccgcaacatccccagatccggagcaatttcaaaatgaaagagaagccctaggattataaaaaaacagaccctaatttgtccgcttttttttgaaaatttgatccaagatgaacataaagagagtgaataaaaaggacatcgtaatcatatctatcagagataaattagaggtttcttttatgagtagcagccataccacctgcaaaactaaagaaatagaaaaataagatatatatgtcatgatcctcatatccgtttcccccttattagcctaatttctcttttgaaatcttatccaaattagtaaaaagaatatccaatcccgaaaataagaaagtgatgaacaatgaaagaagcacttctccgccttgaaatatagatatgttctcaatgatatgattggaaacgtattgaattgagaagtaaacagcagcccatgcaaaaatgaattcaaggatataggctgaccaagcaggcaatgtcaaaacatgagtcattcctttaacaattgccgtaaggattagcatataaactaaagctaaaatactgacgacgacagaaaatatgtataagtctgatagagaatcatatatgatgtaatctccgaaaaaatgatgtattgttacagctgcaaaacaaataatcaggctgggtacagttatagcgaagaacagggagaatccaataagccctatgaatgctgtatgagctaagcggtttggcggtgtatccacgatctctttttttaatagaatcataaaaataagagatgaaatcacaaggcagcataagaaagtgagcaaaacagtaaaaaagacagtcatgtgaaatctccaatgaaaaagtgctattagagtgaatctaacagcactttgcattacttcatacatattttcctgctgatcatttatgaatgagtttaaaatgctttcattgctaaagttgtcaaatgagcgaggtttttagcctggctgtcagaaagtccggactttttaagtgagagataaagattcttttccacatcagtccagcttaaggcgacatactcgttcagcattttctttaaaaccggttctatgtgttcattgaaaacggattcgagttcatttcttattttctttcccgctaatttttcaacaagattgaataattttgttttatttttcagcacctctctgattgcatctttgactggttttgacacagatgcatcgctttgtgctttaagtccgtaggaaaattgcgtatcagtctgataaaaaaatgattttgtcgttccagtggcattggcagtattattatgattttctttagctaaggatgcggggacaaaagcagtagttacaagggctaaagatgcggcaaacagaatgcctttagctgcgtgtctaatgggaaatcctcctttagaaatgtagtgtagagagaaatgaaagactatgtatttaggcgggacctgtatgatccgctttgaacatttttccctctcagataccattctatcaataggtatttttgggtaaataggattttaatacgatatttttctcgcaattcaaaatcttctttggcaggatttattttagctgcagtttcgtgaaatagaacatgggctggagactatataacacatgtacaggctgtttgaggcggaatcacattatcggagcggtttttatcatttaggcttaggtaaaaaaataaacaggcggcatgcctgtttattttcgtttgcgtgaaagagcgaagaaaaacgggaaggcggaaccggccaataacgtaccgaataaaaacatgcctccgatgaacacatgatagttcaccccgccgatccaaagccccgtgattaaggaaatgatacttaatgcgatcatcacaaagccgggaaccagacgtttcttacccgttgtccgataagcaaaaagagaacagaagataccgatgacaatcggcacaatccacagataaaaaaggataaatactgacataagcaaaactccgatttttcttctatcataccaaaaacgcccggaaaaagatacgaacggcacccggtgccaaaagaaaaaccggccgctatggccggtttttttctaacggaatgaatcgtagatcacaaacagattaagcgcgatcaccaaaaccgcaatcagccaggcgagagccgtcacccattttcggttcgtcagggcgcccatcaggcgtttgttgcttgtaaacataatcagcggcacgagtgcaaaggagatgccaaatgaaagaacaacctggctccatacgagcgcttctgtggcgttgacccccgagataatgatgatcatcggcggaatgatggtaatgaaacgccgcaaataaagcgggatacggtaacggatgaagccctgcatgataatatcgcctgacaatgtgccgacagaagagcttgaaagccctgcggccagcagcccgatcccgaagagaatggctgaagccggtccgatatagtggccgaattgctgataagccacgtctaaatcttctacatacagcccgttcttgaagaaaagcgcggcagcgacgatgagcatgcttgcgttaatcgccccggcgatcaccatcgcgatgagaatgtcaatcgtctcaaatctaaaaatctttttccgctcactatccgtttttccgacgacacggcgctgtgtcagtgcggaatgtaagtaaatggcatgcggcatcacggttgcaccgagtataccggttgccaagagcacactgtccattccgtcaattttcgggataaacagcccttcgagaacggaggcggcgtcaggtttggcaaagaaggtttgcagagcgaaggcgatcaccacgacaaacagaagtccggcgatgcccgcttccagcgccctgtaaccccggcgctgcagctctaaaatcgcgaatgatccgattgccgcgataatggccgcttcaaccatcggtatgccgaacagcaggttgagcccgagcgccgccccgataaattctgccagatcagttgccataatcaccagttcaccctgtatccacagcccggcggatacccatttcggataccggtctctggcaatttccggaaggtttttacccgtggcaatgccgagcttcgcggaaagaacttggattaaaaaagccatcaagtttgaaaagaggatgacccacagcagcatatacccaaatttcgaaccagctgagatattcgtagcgaagtttcccggatcaatgtaggcaatcgccgcgataaaggctgggcctaagaaaggcagaagccgcttgaatcccttgcttttgccgtcaagtgcatcctgcacggcttttgcttgcagtgattgtgctgagatgtctttgctcattatgtctcacctaaattctgatagatttttagctaaataacaaaaagtttcctagatgcaaattattttatctacatcataaatccgctattatgagatgtcaagttctttatgttcaataaaccggtacattgatgccctgttttatctatggtatgtatcccgccgaagaaaggtccgaaaatgaaaacggcatcgttccgggaaagaagcgatgccgttctcaacgatgtttccgcacgggttctccattttaaaaagggtgaaagagtacactgtcccataaatcgtcagaaccttccgtccgccagcaaagatttgaaaaaagacggcacatttcctccattttgccgggtaaatagaataataatgaacctttccattggaagataaaaccttcctgtaccattcaaatgacctccggaaaaactccggacgctctgaataaatgtttgaatcaacgatatatcagtgattcaagtccaataaaccgctgttatttatcgaaacaaagaaagtgctttatcattcacgcagaaaagaagttggagcattagacttattccagtcttccgggcgaaaacgtataataacgtcaggaaagctttccagccatatgataaaagagggggaattttcttggtacgtcgtttgtcggtcttttctttagccatgatgtttgttgtttctttattcgcttttggcggctctgcatcagctgcaacttttacacctaaagctgaaccggacgtttccattttagccagcgggggaacagtcggtatttacggtgctaatatgcgctcatgctctaaggtcagctgttcaacaattacaacattttcaagcggtaaaaaaattacaggttcttgggtaaccggtgaatatgttcaaggccactacaccaattctaataaatggctgaaagtcacgtatgccggagcgacaggctacgtgtcagttaccactctttcttattattacggtttataatcagaaaaccccgttctctttagagcggggtttttccatatataccggatcaatttccgcgcttcgtttcatcatcgtgcttcatcagctgatcgatttcttccttagaggcattttctttccactctttcgcctgacttgtcgcaatgggaatagcccgtccttcttcataaccctcatctaccatcgcattcgcgatttcgatcgcttttttcttcacaggttcctcgagattcttcaatgattgcggataatccttcatagaccaaggcatgtctatcactcctttatgaaaagtgtttcccgcctgaagaaaaagaaaaccgcctcatcaaaaagaatgacagctatttttacgagagaccagcaatttccgaataaaatataaaggataaagaagcaagtacagattgaatgcccaccacatgagatcaaaatcaccgataaatacccaaaaggcgatcgcttgcaggcctgaacaaaaggtcagcacaagtgatattaatgcgaaagggtgccataacgcatgtttctgtctataaagaaacatgctgtacagcccggttatcgaaatgaaaatatctaagggaaagaatgaccagttccaggccattatcatggcgttatcataatctttaaacgccatgttttttggaatccactcaaaaaaagtaacaatccaataaatgataaatccaatatctgtaatgaggaagagaacctttaaccctttcatcatctgtttctgtccgtatgaacgctgatgccgtttgatgacgtttcactttcagaaataaagtttaaggaaaccacaccgatgatgatcagaagaacagagacggcttttatgacagagaactgttcatgaaagaaaaaaattccgatcatggaaatcagcacgatccccattcccgaccagaccgcatatgcgatggagacacttatatatttcaaagtcaaagtaagaaaacaaaggctgccgatataaaacaataacaataaaatacttgggacaagttttgtaaatccatttgataatttcatgctgaccgtacccaatacttcaaaaatgatcgctaaacttaaataaatccattgcattcaacattctccttcaatcgtattattcaaaattatacaatatatagaatttgaagaaaattaatcaatggaatgttttccggataaaaagtccggccgggtgtaaaaagaaaacgccataaaggtatactatgtagaaagaaatcagaaaggacgtgcaggacgggtgacagaagatcggacagacctggaaagacaactgagagacattcaaaaatgggaaaaggcgcagcagagggcgatgttctggcaaacattcacccgcttgccgtttcagcttttggacaagctgacaccgcaatttattcagaggaaaatcggactcatactcgatgaaacgggaacgtttattcagtcaggcggacagtaccttacatcagaaaagcgcatcatgaaaaagtttcaaaaacggctgccgcacggtacatgtcaaacgcttcacgacatccgcaatgcgccgcttgccgtcatggacgaaatcgcagaagccatagcgcgtacaagcgtaaaggccgcgacggtgcagggagccgcaacgggagtcggcggcgtgtttacgcttgcggcagacattccggcgatgctcggcctgtccttaaagacgctgcaagacatcgcggttgcttacggctttgatccgaaagacaaaaaagaacgcgtgtttatcgtcaaattgcttcagcttgcatccagtgacgtcatcggaaaaaaagcgatcctgcaagatttacggcaatatgatcaaaacgaccaaacctatcagcgcgtcgcctcgcaaatccaaggctggcgggaagtcgtttacagctaccgcgatacgttcgccgcgaaaaaactgctgcaaatggttccggccgcaggcatcatcttcggcgcgtccgccaaccgttcagctttagaaagcatcgcggaaacaggcatcatgctttataagaaacgccggattctaaaacgcatgaaggatacagaatgataaaaaaccacccgaaaacacattcaatgtgttttctttgtttagcagttctgaaatcgggaaaccaacaaccaacaccaattaaaggaggaattcaaaaatggcacaagataataacaaaatgagcagagaagaagcaggtaaaaaaggcggagaagctacaagcaataaccatgacaaagaattctatcaggaaattggtcaaaaaggcggagaagccacaagcaaaaatcacgacaaagaattctatcaggaaatcggtgaaaaaggcggagaagccacaagcaaaaatcacgacaaagaattctatcaggaaatcggtgaaaaaggcggagaagccacaagcaataaccatgacaaggaattctatcaagaaatcggtcaaaaaggcggagaagctacaagcaaaaatcatgacaaagatttttataaggaaatcggccaaaaaggcggaaacagacgaagcagctaataaaagcataaaaggcagacaacctgcagatcaaaagcgatccggcatatcagctggatcgctttttattttgggaaaatcttgatctgagccgcccttacgatacaataaaatgaaaaaggggtttttcactcgtgtctgacatgctgaatttgctcgctatcgccaataaagtcaaagaaaaacacgccaatttttcaatcgcggagatcaatgaccactgtgtgcgcctcgcagtgtttacgggagaatatgactggcaccatcaccctgactcagatgaatggttcatcgttctggaaggtgagctgctgatcgattttaaggacaaagaaaccgcagtgctcaaagcaaatgacagcctgctcatcccgaaaggcacgattcaccgcacccgctcttacgtcagaaccgtgaatctctgtgtcgagcatacgcatgcgaaaacagtcatcacagaggaactgtcatgctgatcaaaaagattgtatgtgaaacagacgctgcaaacgctgaagcatttgggcaagcacagtcaaggtggggagcattatcctgtgtaaatggcttcgtcaaacaggccggcggctggcggaaaaacgcagacggcctgttcatcgcagagatcatcagcgtttgggagaacagacaggcctatgatgattttatggagaacgaacatgaccgcatatacgaagaaaacgagcagaaggctgcgattctttcaatagaagtgatgctgtacgagggggatgaacctgtcattcacgagctgttacatcacccggacatccgatacgaaccggactggacagttgtgcgcacataaaaaaaagcccctttagaggcttttttattttcgtccgggaagcgtgttgtggacatacggcgggacggggtccagcttagctatttcgccgtgcgctttcggttccttttcgtattcaaatggttctccgtccggcgctgtttccttcagccaattttgttcagcgctttctgctccatctgagaaatgaataagcttatgggagaatgactgtttttccagcgccttcgggaatgtggaaggaacgatcggaccttcctgttcttctaattctttaatggccgcaagccattggttttgatgcatggtatcacgggccaataaaaagctgagcatatctttcacgcctttatcatcggtcatttcatacaggcgtgcgacttgaagccttccttgtgattcggcgttcagattggcgcggaagtctgccagaaggtttccgcttgcgacgatatagcctgcgctccacggaacgcccgtgctgctctccggcattgcgccgagtcctgagacaatggcatgatgcggattcatcccgcctaaaatggacccgatgaccggatcatcagccgctttttcctgctctgccagcggggcgtcttctaacagtctcgcaatcatcgtcgcgatcatttcgacatggccgatttcttcagtcgcggtatccatcagaagatccttatatttttcattgccccgtgtattccatccttggaacaaatattgcatggcgacggatatttccccgtattgtccccctaaaatttcctgcatcttttttgcgaacagcgggtcaggacgatccggttttgccggatgctgcagttttttcgtatgtgtaaacatgtctccatctcctttttttgctctgtccctatttacttccccggcgggaaaagggatgaaacggagatgggcgtattggtcctgctaaggctcgcggcgcaaggataacaaatcctgcacaagcccgcggccgatcacctgttcatattgtccgtaaatcgggtcgaggcgtttcatccatgtgttcttttccgctttgctcagcacatgaatatgaatggatgaattcttctttatctcttcaagctggtctttattcattttctcagcggaggcttcgttccattccgtcgtttctctcatcgcctccgttaagatggttctcgttttttctgtctgtgaattccagaaatgctcgtcggtcatcacggcataaccgaggtatccgtgattgctgattgtcaaataatcttgaacattataaaattttttagaatagatatttgaaatcgtattttcttctccgtctacgagattgctttccaagagctgaaacgtggaattaaaggaatcctgccgcgggtgcgcgccgagcaggcggtactggtcttcgatcacgctgctcggcatgatcctgagcgcctgtcctttcaagtcgtccggagtgaagatcggtcctttatttgacgtgagctgcttaaacccgttcgtccagtacgccagtcctttcaaatgatgcttttctaaagaagcgaacaggcgcgtgccgattttgccgctgaggccttcttgcacggctttatagtttgtaaacgcgtacggcagatccaaaacaccccattcgggagacagtgatccgagctttgaggtggagggggcgatgaattgcacgtccccgttttggagggcgtttatttcttcattatctgaatagaggctcccgtttggaaatacctctactttaatggtgccgccggacttttgatagaccaggtcggcaaatttattcgccgcccgccctttaggcgtgttttcagcaacgacatggctgaacttgaaaaccatttgatctttcaggccttcctgttcgtcatcataatacggttcttccgttgagaaacgatcgtgaaagccgatgaataaagcggttccgataccgagtaccatcaggctgagacaagtcagcaagcttttcatcgaaaaccccctccgccattttctataacaagcataatcgggcgggccgttttcgtaaagagacggaaaggaagaggccaatgacgaaaaaaaagctcaccatccgctggaaaatcaccatactttcgtatatcgtcgtgctttttacctttttgatcgtcggcatcgtgctgatcggcaatatccagcatacagaggagcgcgagctgaaaaaacggctgatgaataccgcgcggacggtatctgagatgaccgatgtcaaacgcgccctggagcagaaaaaacaaagggaagacgtgcgccatgcggtcgaagaaataaggatcatcaatgaagcggactacatcgtcgtcatggatatggatcatatccgctattcacatcccgtcagcacaatgatcggaaagcgttcaaggggtgaggacgaagccgcggcgttcgccgagcacatttatttttccgaagcaaagggagagatcggcaccgccgtccgcgctttttatcccatcaaagaccgggatttgaatcagatcggtgtcgttctggccggtaaaacgctgcccggattcggtgaaattcttcttcagctgaaacatgaaatactgtttatcgttctgctggcgctcgggttcggactggccggctcctttttgctggcccgccacatcaaaaaacaaatgttttggctggagccccatgagatcgtgagaatgtatgaggaacggaccgctacgtttcattcaatgaatgagggcgtcattgcgatcgataatcagcatcacatcaccatttttaatgaaaaagcgaagcagatattcaatgtcagacaagagaccgacggcaggctgatctgggacgtgttaaaagattcgcggctccctgaaatcgtcgagcggaaccgagccgtatataatgaagaaatccaagtcagcggaaaggtgatcatgagcagcagaattccgatcgtcatgaaaaagaaggtcatcggagccgtcgccatttttcaggacaggacggaagcggcgaaaatggcggaagaactgacaggtgtgaaaaattttgtcgatgcgctcagagtccaaaatcatgaacatatgaacaagcttcacaccatcgcggggctgattcagctcggaaaatcagaaaaagcgctccagcttgcttttaaggaatcatcagaacaagaaagcgtcactgattttcttcatcaggccattcagaatgacgctgcggcggggctgctgttaagcaaaatcaaaagaggaaaagagcttggcatttctgtgaaaattgatgaaaacagcagtttctcggcatttccggagcatgtcgaccagcatgacatcgtcgtcctgctcggcaatttaattgaaaatgcgttcggcgcattcgaaacagcggacacggaggacaaacatattgacatcagtatcgagcaaaatgatgaagtgcttgctatattaatagaagacaacggaagcgggatttccgatcagcacatcccgcgcctttatgacaaagggtttaccgtcaataaaacgggaggaacgggatacggcttgtacctcgtcaaacaaatcgtcgacaaagggatgggcgtgattgaagtcgacacacggcagggacagggaacggcattttctatattatttccgatgaagggggaggaatcattcgatggacatcaaggtgctgcttattgaagatgatccgatggtgcaggaggtgaataaagaatttatcaccggtgtttcggggttcagcgtcatcgccacagccgctgacggagacgagggaatcaggcttataaaagatctgcggcccgggctcgtggtattagacgtatacatgccgaaaaaagacggaattaaaacactccaggaaatcagaaaacaaaagctcgaagtggacgtcatcatcgtctcggccgcaaaagacaaagaaacaatccagcttatgctgcaaaacggtgcggccgactatattttgaagccgtttaagctggagcggatgagacaggcgctcgaaaactataaacaatataaacggaaaattgaagagcatgacaccatgtcgcaagagcagcttgacatgctgctgaaaattccgcaaaatccgtcccgggatctgccgaaggggttaaatcattttacgatgaatgaaattttgacctatatgaaacagcagacggagccgctttcagctgaagaagccgccaaagcgctcggaattgcaagggtgacggcgcggcgttatcttgattttcttgagaaggacggccagattaagctcgacattcaatacgggggagtgggacggccggttaaccgctacaaattcgtccgctagccgagaccaaaaagaccaaaatgtccgttatgatcataagcttcccctctttgtatgaaaacgctatcatttttgtatagacgcagcgagaggcaagggggagtagggatgaaaattttcaaaaatcttacggtgcaggtcatcacggcggtgatcatcggcgtcattgtcggactcgtatggcctgatgccgggaagcagatgaagccgctcggcgatacatttatcaatgcggtaaaaatgattatcgcaccgatcatattcctgacgatcgtgcttggcatcgccaagatgggagacatgaaaaaagtcggcaaagtcgggggaaaagcatttatttattttgaagtcgtgaccaccatcgcccttattatcggacttctggtcgtcaatatcatgaaacccggtgagggccttgattacagcaagcttgaaaaaggggatgtctctcagtacacccaaaacgggggacaggggattgactggattgaatttatcactcacatcgttccgtcaaatatggttgacgctttcgcaaaaggcgacattcttcaggtcttattcttttctgttttattcggtgtcggcctggcggcgctcggtgaaagaggcaaaagcattattgatttcttcgataaactgtcgcacgtttttttcaaaatcatcggctacatcatgcgcgcggcgccgatcggcgcattcggggccatggcctatacgatcggtcacttcggccttgattccatcaagccgctggcgagtctgatgctgtctgtatacgttacgatgttcctgtttgtatttgtcgctttgaatatcatttgcaaactattcggtttcagcttgtggaactatctccgttttattaaagatgaactgctcatcgttctcggcacaagctcttctgagtccgtccttccgcggatgatggataaaatggagcgttacggctgttccaaatcggttgtcggccttgtcattccgacgggatattcttttaacctggacggcacctcgatttatctgtccatggcgacggtttttctggcgcaggtattcggcgttgaccttaccatcggccagcaggttacgatcattctcgtgctgatgctgacatcaaaaggcgcggcgggcgtaaccggaagcggatttatcgtgctcgcctccactttatcggcacttcaggttattccgctggagggactggcgctgctcctcggcgttgaccgctttatgagtgaaggaagggcgatcgtcaacctgatcggaaacggaatcgccaccatcatcgtagccaagagcgaaaatgagtttgacgaagcgaaaagcacacaggccgtaaaagagatgaaaacggcggtataaaaggaaaggaacggcatgcatccggcatgccgttctttttttcggctgccatgagtaaaaaagataaatttgtttaaatttattaggaggtggacaaagaccttagcgtcattttgttatataatttacaattagagagtgaaagatgaaatctaagggctttttgtcctagcaggagtgtataaatggcggctatttttaaattttttcagcatccgggtgtcagacgtttttccgtttttcttgttttgactggggtgttagttgtattccgaagtatgattaatttgattttgcttacgtttatttttacttttctgatggatcggctggagactgtcatccggcacgtgttgaaccattttttccggatcagccagagggtggtcatcaccattttatatattgcgctggctgtcggggcgactgtcggaggctttgtcttttacccgattgttgccaagcagattgaacagctgattaagcagatcaagcacatcgcgtatcatcccgatgtcattccgttttatgatgagatatcgagcgtgttcggcgatatcaatatcggttcctatgtaaaagaaggttttaatgtactgtatacatacttggccgatatcagcactttcggtttgcaggtcgtgatgtcactgattctcagcatgtttttcctgttcgagaaaaagcggctcacggagtttatgaaaaaatttcagcacagcaagctgtctgttttttactacgaacttgcttatttcggcagcaaatttgcgagaacattcggcaaagtgcttgaagcccaatttattatcgcgctggtgaactgtatcctcaccttgatcgcattggcgattctgcattttccgcagctgttcggcctgtccatcatggtctttttcctcgggctcattcccgtggcgggtgtggtgatttcgctcattccgctcagcatcatcgcgtatacgacgggcggcgctgcgtacgtcatctacatcgtgctggtcattttcgtcattcatgcgattgagacgtacttccttaatccgaaactgatgtcagcaaaaacggaactgccgatcttttttacctttacggttctgattttctcagaacatttcttcggcatttggggcttgattatcggaattccgatttttgtgttcctgcttgatattctggatgtcgtcaataatgaggacaaggaaaaaaacggaccggctcctgataagacataacgtcggctccggctcttcacgaatatatgactaatgttataatgcagacagtgcctatgtacgggcactgtttattttttgtgaaaaaggaggaaggctgtatgactgagccgattttacatattgaaggccttgacaaaacaataggcaaaaagcacattttaaaaaacatcagcatggatgtcaggcagggcgagatcatcggtttgctcggtccgaacgggtcgggaaaaaccacacttatccgaatcatcgtcggccttttaaagaaaaacagcggcacgattacaattaacggctttcagcacgatgctgatttcgaaaaagcgcttgaatccgtcggagcgatcgtggaaaatcctgaattctacccgtacctgacggggtgggaaaatctgaagcactttgccaacatgcacaaaaacatcaaagaggacaggcttcaggaagtcatcgagcgggtcgggctcacaaatgccgttcatgacaaagttaaaacgtattcccttggcatgcgtcagcgtctcgggattgcacaggccattcttcaccgtccgaatctgctcattttagatgaaccgacaaacgggcttgatcccggcggaatgaaggatttccgcgatcacttaaaggaactcgcggagcttgaagggacgagcatcctttttgcgacgcatttattgcgtgaagtggaggacctttgcgaccgtgtcatcatcattcaaaaaggtgagatcaaaacagaggttgttctgcgcggcgctgcggaaaaagaagaaaaagccatcctcgacattcagccggctgacgcagcattcgaatggctgtcccagcagcaattcgttccggagaaaaacggcgggagcattaccgtcaccgtagcgaagaaggacatcccggcattaaaccgtgcgctcgtcggacaagactttctcgtgtattccatcatgccgtatgcggaatcgctggaggatgaattcatgaaagtgacgacggcgcttcaagaggagggggagacgaatgtttaaattgacagcgaatgagcatatgaaactctttaaccgaaaagtctcattagtggcgctgattctgatggctgttctccaatttattatggcgcttgtcattaaacggcttgtcatcagttccggaacggatgagaatttcatcggctatatggcgtacgcccccgggctgaatattctgcttgaggcattaacaatcgttatcgcggcaacgatcatttccgctgaatttgataagaaaacgatcaaatttttgttgatccgtccggtaaagcgggagcggatttttgtatctaaactcattaccgtatttttggtcagcttgtacctgtatgcggcgtactatattctgtctctgctgttcggcatggctttcttcggagtgtcggtgacatctgaatcagggacgcttcttgtgaacaccctgaaagtaatcggcacgaactgggtcgaggcgtttgcgatggcatgctttggcttgttgtgttcttctgtattccgaaacagtgcaacggccgtcattttgtcatttatcgtgctgtacggcgcaaaatcccttgtgacgattatgtcgctcttccaaaacaaatggggaagttttctgctgttcgcaaatactgacctgacgcaatatatgagcggggcgaaaccgctgtttgcgggaatgacgccgttattttccgcaggcattatcattatccatatcgtattcttcttagccgttgcttggtggagcttttgcaaacgagatgttcgggtataaagtaaaggaatgacatttttgtgaaaaagatcacgataaatcaataatttatgctattttgatttataataaaggtaatgacggaggtgctcacttgagaaattttattaccgcattaccgattgtgttattgcttggtttttcctttttgtcattcatgtttcaattcgaacatcttgtttatttcaggcttgcgctgggtttgttttctacagtggggctgtttctcttatataaaatgaagacgggattccgttatttcatcatctacctgtatgcaagctggatcgtgcttgcggcggttaccgcgtttgaagagccgattttttcaagctttttctttggcgggcttgtgatgacgatgggttatctcacatatatgctgatttatctcgggctcaagcaggaccgcggcccggaagcagtctgaacgcgctattccatggaatagcgtgttttttttgtacagcctcacagttgcgaaacgagacttgaatctctataatacttattaactttatcggaattataatggggggattccagtgtctttatggatacagaatgaacggcagcgggaatggatggaaaaaatcggcctgcttgcagacgaatttcaaaaaacagccgcgcttgatgatgaggcgggccgttttcccgcggagaaaattcaaagactgcgcgacgcgggatatacggcgttaacggtacctgaggcattcggcggtgcaggcatttccgtttatgagatggtgctgtttcaggaacggctggcgcggggagacgcggccgtcgctctcggaatcggctggcatttatccgtcatgggtgagctcggagaaggaaacagctgggatgaagatgtcttttcatttatcacagaagaggtgaaaaagggagccgtcctgaacagggcagcgacggaacggcagaccggcagtccgacgaggggaggaagacccggcacctccgctgtcaaaaaagacggaaaatgggtgctgaacggccgaaaaacctttacaaccctttcgctgactttggattatatgcttgtgacggcatggattgaagaaaaacagacgaccggtgtttttctcattcataaagatcaggcaggcgtttcagtcgaagaaacatgggatatgattgccatgaaggcgaccggaagccatgatctccttttagatcatgtcacggtcagtgacgagcggcttgtggagcttatcagcgggccgagagcggcgaaagtgaatggctggctgcttcacattccagctgcttatctgggcatcgctcaagcggcaagggactatgccgtccggtttgcatccgaatattcgccgaacagcctgaacggaccgattaaagacgtgccggccgttcagcagcgtgtcggggaaatggagcttgaattgttaaaagcgagacagtttctctttacggcggcccaaatgtatgatgacccgaaacgccgccctttcatcaaaagcgagctcggtgcggcaaaacatattgtgacaaatgccgtcctttctgttgttgacaaagcaatgagaatcaccggcgcaaaaagcctggagcgaaataatccgcttcagcggtattatcgggatgcccgggccggccttcacaatccgccgatggacgatgcggtcatcggcaaattagcggcggaagcctttgagtaataaaaaaagagcctgaaaaaggctctttttatgtatggctgttgtgccggagcagtttttgatgcttgcggtcaattctgtcatagatcacattcatcagcttctgattattcataatggccgccttgttttcttttatcagctgttcgtatgtttttattttacgtttcgccatgagcccgcaccttccttacatatttgtattcgctttctaattctccgagcgataattcatataaatgccgttccgactttttgtatattccgttattgatcagcaaatggatcagatgtttttttcgtccttcaacggatgatctgagctgaggagaagacctcatgattaccctcctaatcaaatgatattgagaatcattatcagttaatgaaagtatacaatggacatattcatatgtaaaggaaaaataccgccaatttttcgacaaaagtttcccggggaataatgctgtcgaatattgcatttggtcagatcaaagctgctatttttccgcttttccatccatactatgaatgagaatggaggagtccttgcatgaatgatcaaacggcaaacttaaaacggggcgaaaaaggcgcgattcttaatatcgccgcgtacctcatccttgccgccgtcaaactggtgatcggtcttatttatcattccgaagcgctcagagcggacgggttaaataatgccacggatattgtcgcatcactggctgtgctgatcgggctccggatttcccagcgccccgcggacagtgatcatgcctacggacattatcgggctgaaacaatttcttcattaattgcgtcttttattatgatggcggtcggtattgaagtgctgatcggaggagcaaaggcgattgtcagcggaacggaggccgagccgagcttcattgcggcatggacggcgctcggaagcgcgattgtcatgtacggcatgtatgtatataacagccgtcttgcggatcgggttaaaagttctgcgcttcaggcggcggcgaaagacagccgttctgacgcctatgtcagtattggggcgtttataggcgtcttaacggcccggcttcatctgccgtggattgatccggtcattgcctttctgatcggaattatcatctgtaagacggcatgggacatcttcaaagatgcttcccactcattaacggacgggtttgatctgaaagatttggagccgtataaacacacagtgaaagaaataaaagaggtcagcaggctgaaggatgtgaaagcaaggtatttggggagcacggttcatgtggaaatggtcattacggtagatccgggactgtctgtgaaagaaggccatgaagtagccgatgaagtcgaatatgcaataaaacatgaacatgatgtgactcatgtccatgttcatgtagagcctgaagtcataaacaaagatcgtgaaacgaattaaatatgctgtgataaaaactctgtgacttcttcgggcgttttcgcgtttgcgctgtgaagatgcgctttcttttcgccgtttttaaagatcagaaggctcggtatgcccattacctgatatttgtcggcaagctcagggagctcgtctctgttcagctcataccaatcattttgattatattcttccaaaatatcgccgatgaacatattcatgcgcgtgcagtcagggcaccagtcagcgaaaaatttcacgatgatttccttgtcggattgaataagttcattaaattgttctgttgtactgatttttttcatatgacacatctccttttccatgccattttaatataaaataaaaaggaattacatacaaatgctttcatattcagaatgcccaaaaataattagatcattttctgaggaaagtgataagatagtaaagatgaattgttgtgggggaatatccattgaaaacaagtctaggattggtgtacggcggaaagtcagccgaacacaatgtatcgctgcagacagcattagctgtaacaaaagcgcttaatactgagaagtttgatatacatccgatttacatcactgaaaaaggagaatggcaaagaggcccgctgctgactgagccggtttccaacgtgaaaatgcttcagctggaacaaaacggtgaaagtttcgctctatcagcattgaaccgggaaatgtttccagaagcgtcgcctgacgaaaaggcgccgatcgatgtcgtatttccgcttctccacggaccgaacggtgaagacggcacgattcagggtctgctggaattgctgaacgttccttatgtcggcaacggcgtgcttgcatcatcagccggcatggataaagtcatcatgaagcatttgtttgctcaagcggggcttccgcaggcgaagtacgccgcttttttaaaaaaggactggaaacagacgccggacagctgcttacagcaggttgaagaggagctgggatatccgtgcttcgtcaaaccggcgaacctcgggtcaagcgtcggaatcagcaaatgccgaaaccgtgaagagcttgaaaaagccttcgaactggcttttgagtatgaccggaaaattgtggtggaagaaggaatcgccggcagagaaatcgaaatcggcgtgctcggaaatgacgaaccgaaatgctccgccgtcggtgaaatcgcgccgaaaaccgacttttacgattacaaagcgaaatatgaagacggcgacacggatttaatgattcccgcgcaagtgacggatgaacaatatgcggaaatcagcgagatggcgattaaagccttcaaagcgattgacggatcaggccttgtccgcgccgatttcttcctgaccaatgacggtcaagtgctcattaacgaagtgaacacaatgccgggctttacgccattcagcatgttcccgctgctttggaaagaagcaggcgtagattacagtgatctgatcgaacagctggttgagctggcaaaagaacgccatgccgaaaaacagctgattaaacatacattttaatgaagacggacactgcctgaaggggcagtgtcttttcccgtaacagacaacattttcagaaagcgaggtgccacctttgataaagcgaactgtaaaacgaatcgccgacatggtcaaaggcacactgacaaatcctgtatttgaacaaacaatgattgagggcgccgcaaccgatacgcggactttggaaaaaaatcagctgttcattcctttaaaaggcgagcattttaacggccacacttttgtgccgcaagcattcgaaaaaggcgtttccgcggtgttgtgggaccgctctgaaccgaatccgccggaagagcgtgctgtcatccttgtcgatgacacgctggaggcgctgcagacattggcgaaagcttatttgaaagaactcggcacacgggtcatcggggtgaccgggagcaacggaaaaacgacaacgaaagacatgcttcacgccgttctcggcactcagtaccgcgttcacaaaaccgccggcaatttcaacaaccatatcggcctgccgctgaccgtgcttgccatgcctgaagatacagaaatcgccgttttagaaatgggaatgagcgcgagaggcgaaattgattttctgagccgtcttgctgaaccggaagctgccgtcattaccaatatcggcgaatcccacatgcaggatttaggctcaagagaaggaattgcggaggcgaaacttgaaattataaacggacttcgggaagacggtgttctgttttatttcggggatgagccgctgctccgcgaaaaggcgtacacttgccggacaacgacatacggcgcaggcgctgacaatgatctccgtctgaaagaaataaaacaggcggaagaaggcacgtacttcaatatcgacgggatcgaacgttctttctttattcccattctcggcagacataatgtgatgaatgccatggctgcatacgccgccggcatctatttcggcattacgccggaaaatgccgctctgggactgagccgcctgaaggtgacggggatgagattggaactggttaaaacggacaacggcatctcgatcgtaaacgacgcgtataatgcgagcccgacgtcaatgaaagcggcggtcgaattaatcgaaacgatgaaaggctatcggaagaaaatgctcgtgctcggtgatatgcttgaactcggtgatgaagaaaaagcattccacgaagaatgcggagctgcgatcaatccggcggaaatcgaccatgtatttacttacggcacactcggcgcattcatcgctgacggagcgcgccggcattttgaagaagggcgcgtcagccattatcttgacaaaaaagaactgctttgcgccatacaggaaaagaccgcttccggcgatctccttctgtttaaagcatcaagaggtatgaagctcgaagaaatcgttaaagatttattagagaagaactgaaaaaataccgatcagcatcataaaaatatacaaaaatgaagaaactaattcagggtgaaataattctgtccgtatgaaaaagcaaggccgccggctgggaaatcccgtccggcgcggggtccggcctcgttcgcgggaagaatccggtcaggccgcttccggccgcctgaccatctcgccttattgaaaaacacatagtgtaatggtaagattaaacgtaaagtaattcgggctttgtatacgtatgatcctgtcctttggatgaaagggcagtttttagtggtaaatcacgacattactgaaacagcaatcagaaggagtttgaataatttgactataacgtttcaagatttccaattaagttctgatctcatgaaatcaatcaatcgtatgggatttgaagaagcaacaccgattcaggcacaaacgattccgctcggacttttaaataaagatgtcatcggacaagcgcaaacaggtacaggtaaaacagctgcgttcggtataccccttgttgaaaaaatgaaccccgagtctcctaatattcaagcaatcgtaatcgcgccaacccgtgaattagccattcaagtatctgaagagttatataaaatcggacaagataagcgtgcgaaagtgctgcctatttacggcggtcaggatatcggacgtcagatccgcgcattgaagaaaaacccgcatatcatcgtaggtacgccggggcgtcttcttgaccatatcaaccgccgcacgatccgtttaaacaacgtgaacacggttgtcatggacgaggctgatgaaatgctgaacatgggattcattgatgatattgaatccattctctcaaacgtgccgagcgaccaccaaacgctcttattctcagcaacaatgcctgcgccgatcaaacggatcgcagagcgtttcatgactgagccggaacacgtaaaagtaaaagcgaaagaaatgactgtgtccaacattcagcagttctacttggaagtgcaggagcgcaaaaaattcgatacgctgactcgtcttcttgacattcagtctccggaactagcgatcgtattcggccgtacaaaacgccgtgttgacgaattgacggaagcgctgaaccttcgcggatatgcggctgaaggaattcacggcgacttaacgcaggcgaagcgtatggtagcgctccgcaagtttaaagaaggtgcgatcgaagtgcttgtagcgactgacgttgctgcccgcggacttgatatctcaggtgttacccacgtttacaactttgacgtgcctcaagatcctgaaagttacgttcaccgtatcggaagaacgggacgcgcaggaaaaacgggtatggcgatgacgtttatcacaccgcgtgagaaaaacatgcttcgcgcgatcgaacaaacgacaaaacgcaaaatggaccgcatgaaagagccgacgcttgacgaagcattagaaggtcagcagcaggtgacggttgaccgtctgcgtacggcgatcagcgaaaacaacctgaacttctacatgacggcagctgcggaattgttagaagatcatgatgcagtgacagttgtggctgcagccattaaaatggcgacaaaagagccggacagcacgcctgtacgcctcactgatgaagcgccgatggtcagcaaacgctataaaaaccagcgtacttctaagcgcagagacggccaaggcggcggctaccgcggcggcaaagggaaaaacaacaaccgttcttcctacgataaaaaacgctcaagcgaccgccgttcttcaggtgacagacgccagaaaaaatcttactaaaacactggaagcggacccttttacggggtccgctttttttgatatgccggaaagtgaatcttttttgcaaatcagccgtatttgtatgtatgataaaaatgggaggtaggtatgttgagagcacagccaaaaaatcgaatcagtccaagcggcttaaaagtctggcgtcttcaggaaatcatcctgtccgccttctgtcttctggccgttatagcagcagctgttttaagccatttcttccattggccgtattggatcaccggagtcctcggcatcatttgggtcatcggttcagtgatatccgtctatgccataccgaaaatcaggcacaggatctggcgctatgaggtccatgaaaatgaaattgatattcaatccggcatttttatagtcaaacgggtcattgtgccgatggtgagggtgcagcacgtagatacttcacaaggcccgctcctcagaaggtaccgtctggcctcagtcaaaatctccacggcggcaaccgttcattccattccggcgcttgatatggaggaagctgaccggctgagggattccatttcccgtctggcaagggtgacggaagatgatgtctgagccgaaacgtctgcacccggcggccgtgattttgaacttattccatattattatcgaaaccattaaaaacattattctgccattttttctcgtctatattgttaattccaaccacttcatccgcttttacggaggcattgcgctcgccgtcctgcttatctggctgattacggcaagtgtgatcgagtggagaaaatttacataccggattgaggacggagaattcagaattgaagaaggcttgttttttacgaaaaagagatacatctccattgaccggattcaatcaatgaatacgagtgccggcatcattcagcagctgtttaagcttgttaagcttcaaatcgaaacggccggcgacgggaaagacgccgaggctgtcttatccgccattacggtggaagaggcggaacggatcagagcggctgtttttcagcaaaaagcggagcaagaagaacgaggggagaccgcagcggagcaggagccgatgcgcggggaagatgtgcaatccgtttaccgcctgtctgtgggtgagctgcttatggccgcctcaacatccggggggatcggtgtcatcatctcagcggtattcgccctcttttctcagattgatgaagtacttccgatggactggctctatgacaggttttcctttctcaagcatgcgagcatcggcatatacgccgtgatcattttcataggattgttcatcgcctggctgttaagcatcgccggtatgatgatcaagcatgccaactttaagatagaaaaaaaggaacacgaattggtcattacgagaggaattattgaaaaacatcaagtgacgatcccgctccgtaaaatccaagccattaaaattaaagaaaatgtgatcaggcagttattcggatacgcgacggttgcgattgtcagcgccggaagtgcggggaatgagaaagaaggagctcagacgattctgtttccgatcatccgcaaatcaaagctcggtgtgatgctgaacggtttcacaccggattacgtactggaagaaaacaggaatcatttgccgaaaagggcgctgcgccggtatttattccgctccgttatcttctcggttttcgtgatcattccgctttgtattctgtttaaaccgtggggatatgcatcgctccttgtgcttcccgtcgaactggtgctgggctacgcctcatttaagagcgcgtcatggtgcttaaacggcggccggctgcagctcaccacacggctgatcgggaagacgaccacgattatgctgagaagaagaatgcagatgtttgaagtcagccgctcctttctgcaaaaaagaaggcggctcgcatctgtggctaccgcagtgaaatcagctcaccacatggagcatgtcatgctgaaggatgtcagcgaggaagatgccgaacgcatcgggcgctggtattcatatgaaaaagcggacggttaataccgccgctttttttgctgcacgcataaaaaggaaagcaaaaatccgcctgccaatccgaacaaatgcgccataatgttaatattagaattgataaacgtcgacagtaccgcgatgataagcagggtcataatcattttcgactgatcccggccgatcagctccttgcggaaaacagtcagaaacacatacacgccgaaaagtccgaagatcgcgccggatgcgccgacatgcacataatcaagcggttcggcaagatacgtgccgatattgccgataatgcccgatgcgatgtacacaatcaaaaaacggacttttccgagcatctgctccagcgggggcgcgaataaaaagagagacatggagttaaacaaaaggtgagtgaaattcgcatgtaaaaacatcggtgtcaccagccgccaccattctcccgaggaaacgccgtaattatagccggtcactgcatctgaccacatcatgacggaatgaagcggcatactgaaaaacagccacaagaacgcctgcagcgccaagatacagctgacggccggataacgtctgataaaagtctggaaattttccgtacgtataaacatcgcaagcccctttgcatctgatttgttacatatatagtaacacgtttatgacataaaccgttttttagtacggacttttaggaggaattcacatgattttcggaatcggaatcgacatcgttgaactgcacagaattgaaaacatgatgagccggcaggcgaggtttccgcaaagaatattgacggaggctgaatacgcccgttttacattgctgtcggataaaaggaaaattgaatttctcgcgggaagatttgcggcaaaagaagccttttcgaaagcatacggcacaggtatcggcaaagagctcagctttcaggatattgaaaccggaaacgacacggcgggcaagccggtgctgacctgcgccaagctggacggcgcggcggttcacgtctccattacccatacaaaagaatacgccgcggcacaggtcgtgattgaaaggttgtcacgctagtctgcatattagccgaaaccccttcatatatttgatagtgcattaagggagacaagttgtttgaggcttttatggtacgcgtccgtccgttcagggcgtaccgttaaagtcaaacaagcgatttcttccctttacatcaattgagaagaaggggttgaaaaaaggtgagaaaaagctttgttttgcttttaacgggactgcttgccgtccttattctttcggcctgcggccaaaaatcacaggaagatatcgtgaacggtttagataagaaggcgaaagaatacacctcgtacaaagcgaaagccaaaatgaccattcagacggggagtgatccgcaagtatacaatgtggaaatctggcataaaaaaccttccctgtaccgggtctatctggaaaatccgaaaaaagaccaaaaccaagtcattttacggaacgccaacggagtctttgtccttacgccgtctttaaataagagcttcaggttccaaagcgattggccgaataacagcagccaagtatatttgtttgagtcacttgtaaaggacgtgcagcatgacaaagacgccgtctattccgccaaagataaaaagtacacgtttgaaacaaaaacaaactatcagcacaacaaaatgctgccgactcaggaaatcactttcaacaaaaaggacatgagcccgtcgctcgtcaaagtgatggatacagaccggaaagtgatggtaaaagtcgaattcaaaagctttgaattcaacaagccgtttgataaagactcttttgacgagaagaaaaatatgacgctttcccagatggacgtcgccacaagcgccaagccgtctgattcatttgcggtcaaaacaccgcttcaagtgccggccggcgtcaaaaagcttgaagagaaagatatttcaacggcggacggcaaacggatcgtcatgacttacggcggagaaaaatccttcacccttattcaagaaaaagcccatatcgcaaaagccgcctctgccgtcacgctgaaaggcgaaccggttaatctcggcttcacggtggccgcattatctgatacgtctttaacgtggacatatgacggagtcgattatcttctgtcatcacaggatctgacaaaagatgaaatggtggccgccgctaaaagcatgcagggacagtcgtcaaaataatgtcaaaaaagaggccgccgctgtcggtctcttttttgattccatttcactttgcagaataattttagtatgataataacaatatgaattgaaaataatgctaggaagtgtatcgaatgaacacagcatccttttacagagaaacgtgggcggaaatcaacctgtccgcgattaaagaaaatgtcacgcatatgaaaaaacacatcgggcaaaacgtccatctcatggcggttgtaaaggcgaacgcttacggccacggagatttggaagttgggaaagccgcgcttgaagcgggtgcctcttgtcttgccgtagccatactggatgaagcgatttcattgagaaaacggggcattacagcgccgattctcgtgcttggcgccgtgccgcccgaatatgtacaagcagctgccgagtatgacgtaacactcacggggtattctgttgaatggcttcaggaagctgcgcgccacctcggaggtgccacattgccgtttcatctgaaagtcgacaccggcatgaacagactcggagtcaaaacggaggaagaaatccaaagcgtgttaaaaatcctcagccaaaatcccggtttagtctgtaaaggtgtattcacccattttgctaccgcggatgagaaaaacagagattatttcctcttccagtttgaccgctttaaaacattgatcgctccgctccctttaaaagaattgatggtgcactgcgcgaacagcgccgccggacttcgccttaaaaaaggcttctttaacgcggttcgtttcggcatcagtatgtacgggcttcgtccttctgctgacatccaaagcgaaattccgtttcaattaaagccggcttttgcgctgcactctgtgttatcccatgtgaaaaagatccgcaaaggggaaagcgtcagctacggcgcaacatatacggcagagaaggatcaatggattggaacggttcccatcggctatgcagacgggtggctccgcaagctgagcggcacgtctgtgctgatcggcggcaaacggatgaacatcgcgggaagaatctgcatggatcaattgatggtcgaattagatcactcttatccgccgggcaccaaagtcaccctgatcggcagccagaaggaagaaacgatcacgatggatgaaatcgcagggcggcttgagacgattaattacgaggtcccttgtaccattagttcccgcgttccccgtatgtttttggaaaatgagagtataatggaagtaagaaatcctttactgcaagataatacaaacaagtagccgtcatccggaaaaagagaatttataaaacagctttgcttgacgtttgaataatggtatcattatgtctggatggatgaattggtcgtatccgtaagtttggtggaggtgtatgttttttgtctgaatccagcgcaagaaccgaaatgaaaatcagcttgcccgaaaacttagtagctgaattggatggtgtagcgatgcgggagaaacgaagcagaaacgaactgatatcacaagcagtgagagcgtatgtcagcgaacggacgactcgccataaccgtgatttgatgagacgcgggtatatggaaatggcgaaaatcaacttgaatatctcttctgaggctcactatgctgagtgcgaagcagaaacgaccgttgagcgcttagtcagcggaggataatcattttgattgtaaagcgcggcgatgtttattttgctgatttatctcctgttgttggctcagagcaaggcggcgtacgcccggttttagtgatccagaatgatatcggaaatcgctttagcccgactgctattgttgcagccataacagcccaaatacagaaagcgaaattaccaacccacgtcgaaattgatgcaaaacgctacggttttgaaagagattccgttattttgctggagcaaattcggacgattgacaagcaaagattaacggataaaataactcatctggatgatgaaatgatggataaggttgatgaagccctgcaaatcagtttggcactcattgatttttagtcatattttggttgctcatatagagcaactttttttgttttcgaaaaacataagcgctataataaagagataatcaaacaaaatttgttgttttgtgtcgggaggtcagtgaaacccatgtcgaatcagaaagtgtatcagttcattattgatcagcatgatgaactgcttgatacttggacagccaaactaaaagaagtaggcaatcaggaagactatcagcttacgaatcacatatgtgaaaatatttgtaaagactatatagacattcttttattatcgacaaaaaatgacgaggctacggaagagcagatcagtgaactcgcactgcgcgccgttcagctcggcctgtcgctgaaacttctttcagccaccctgtcagagttttggaaactgctttacgaaacgatggtcgaccttaatatggccgatcaggacagagcagatttgattttggaaatagacagctttttcaatccgatcaacacggaaattttaaatcagtattctatctcctgggaaaaaacggttactttgcaaaaaatcgcgcttcaggaattgtcggctccgctgatcccggtatttgagcatgtaacggtcatgccgcttgtcgggacgattgatacggagcgtgcaaagcatattatggaaaatctgttaaacggcgtcgtaaagcaccgttcacaggttgtattaattgatattacgggcgtgccggtcgttgatacgatggtggcgcaccatattattcaggcatcagaagcggtgcggcttgtcggcgcgaaatgtctgctcgtcggaatccgtccggaaatcgcgcagacgatcgttaatctgggaattgatttgtcgcaggttattacgaagaatacccttcaaaaaggaattcaaacagcgcttgaaatgacaaatcgaaaaatcgtttcattgggggaataacattgtgagacatccaaaaatcccgatcctgaaactgtataactgcttattggtatccatccaatgggagcttgacgaccagacagctttgcattttcaagaagatctgctgaacaaaatctatgaaaccggcgcaaacggggtcgtcattgacctgacatccgttgacatgatcgattcatttatcgcgaaagtgctcggcgatgtcatcaccatgtctaaattgatgggtgcaaaggtcgtattgacgggaattcagccggctgtggcggtcacattgattgaactcggaatctcacttgaggaaatcgaaacggcgctcgatttagagcaagggcttgagacattgaagcgggaattgggggaatagcgatgaacgaccaatcctgtgtgaaaatcatgacagaatgggatatcgtagccgccagacagcttggccgcaacgttgcgaaggaattaggcttcggcacggtggaccaggccagaatcacgacggctatctcagaattggccagaaacatttacttatatgcaggcaagggccaggtcagcatagaacaagtaaacgacagagggaaaaaaggccttaaaattatagcagaagacaaaggacccggaatccccgacatccgtaaagtgatggaagacggcttttcaacgtcaggcggactgggagcgggacttccgggcgtcaaaaggctgatggacgaattcagcctgcaatctgttgcagaggaaggaacagagattcaagccgtaaaatggcttcggtaggaggttagaacgtggatttcagggaggttatagagcagcggtatcatcagctgcttagccgatatatagccgaattaacagaaacatctttatatcaagcccaaaaattcagccgaaaaacgattgaacatcaggttcctccggaggagatcatcagcatccaccgaaaagtggtaaaggaactgtatccggatctgccggaagatgtttttcattcgctggattttttaatagaagtcatgattggctacgggatggcttatcaggaacaccaaagtctgcgagatatccagcaggagcttcgttcagaaattgaaattgccgcaaatgttcagcagacgctgctgggcacaaaaattcctgaagaagaagaactggatatcggggcgatcagcgtccccgccaagcaaatgagcggggactattatcactttgtcaaagacaaggaatcgattaacatcgcgatagccgatgtcatcggaaaaggaatacccgccgcattgtgcatgtcgatgatcaagtatgccatggactctcttccggagatcggcattcacccctcccaagtgctgaaaaatcttaaccgcgttgtagaacagaacgtggactcaagcatgtttatcaccatgttttacgcaaactacaatacgaaaaatcaccaatttacatatgcttctgcggggcatgaaccgggcttctactactctgaaaaagaaaaaaagttttatgatctggaggcaaaaggattggtgctgggaatttcccaggattttgattacagccaatatgaacagcacatggacgaaggagacatgatcgttcttttttctgacggcgtcaccgaatgccgcaccgaaaacggtttcttagaacgcagcgacattcagcgcatgctggaagaacatatggactgctccgcgcaggatatggtcaaaaatatttacgacagcctgctgagacttcaggactttcagcttcatgacgattttacgttaattgttttgaaaagaaaggtttaaaaaaacagcagcacgggtaaaaagccattagcacgagtaaggataactttcagaggtgatacgatgaatttaacggtagatatgaaggagaatctttcagatatacaaatcaatatcgctggagaaatcgatgtatactcagctccggtggttcgtgaaaagctgatgcccctggcaaacgaggggaaggacatgagaatctgcttaaaagatgtaaactatatggacagtacgggtttaggcgtttttgtaggcgtgtttaaaacggtgagcaaggaaggcggctctctgaagcttgagaatctttccgaccggctcgtccgtctgtttgaaattacggggcttaaggacatcatcgacatttcggcaaagtcagaaggtggcgtgcaatgagtacatcagttgattatatagagatgaaaattccggccgaaccggaatatgtaggaatcgtcaggcttacgttatcaggagtcgccagcagaatgggctatacctatgatgacattgaagatttgaaaatcgctgtcagcgaagcttgtacaaacgctgtccagcatgcatacaaagatgaaaataagggagaagtatccgtgcggttcggtgtgtttgaggatcggctggaggtcattgtcgccgatcagggagacagctttgattttgatcagaagcagcaggatctcgggccgtacacaccttcgcacacagtcgatcaattgtcagaaggagggctcggtctgtatttaatggaaacgctcatggatgaagtcaaagttcaaagcaactctggcgtaaccgtggcgatgacaaagtatttaaatggggagcgagttgatcatggcacaaccatcaaaaactacgaaactaactaaagatgaagttgatcggctcatacgcgactttcaaacacatgataataaagaagcccaggaaacactcgtcgaggtgtataccaatctcgtcgaaatgctggcaaagaaatattcaaaaggaaaaagctttcacgaagacctccgccaggtcgggatgatcggacttctcggagccattaaacggtatgatcccgaggtcggcaaatcctttgaagcatttgcgattccgaccatcatcggcgagatcaaacgcttcctcagagataaaacatggagcgtacacgtcccgagacggattaaagaactcggtccgcgcattaaaatggcggtggatcagctgacgacagagacgcagcggtcgccgaaagtcgaagaaatcgcagcctttctcgatgtgtcagaagaggaagtgcttgaaacgatggagatgggaaaaagctatcaggcgctttctgtcgatcacagcatcgaagcggatgcggacggaagcaccgtcacgattttagatatcgtcgggtcgcaggaggaaggatacgaacgcgtcaaccagcagatgatgatcaaaagcgtgcttcatgtgctgtccgaccgcgaaaaacagattatcgatctaacatttgtgcaaaataaaagccaaaaagaaacaggggacattctcggaatatctcaaatgcacgtctcgcgcctgcagcggaaagcggtgaaaaaactgagagaggccttgattggagatccctccatggagctaatgtaatgattcaggttgaagaaaatgaacatgttcaaactctcgtataccaattaaataaagaaggcaagtccatatgcggcgacagcttttttatgaaggcgaatgaagaagaattagtttgcgcggtagcggacggtctcggcagcggatctcttgccaacgaatcctcgtcagccattaaagacatcgtggaaacgtatgcggatgaggatgtggaaagcatcattgagcgctgcaatcaagcgatgaaaaacaaaagaggggcgactgcctccatcttaaaaatcaatttcatcaaaagggaattgacatactgctcgatcggcaacgtccgtttcttcctgcactccccatcaggcgaagtctttcatccgctgccgatttcgggttacctctcaggcaaaccgcaaagatacaaaacgtatacgtcatcatacgaaaaaggggcgacattcatcatctacacggatgggcttgaggttccgcatatccgcacctgcttaaagcagggacactcaatagaagaaatatcaaaatcacttcatccgtacacaacatccagacgtgatgatttgacctatattctcgggcagcttttatcgtaaggctgctttttttatgttccgccgttttttgatacactagagaaagaaagaagagatggaggcttttgtgatatggaaacgttagcccttttgaaaaaacaaattgctgaagaaacagcgttatcccaaaaacatgtcgaaagtgtcatccgcctgctggaagacggcaataccgtcccgtttattgcgcggtaccgaaaagagcagaccggctcaatggacgaggtgcagattcaggcaatctccgagcggtggcaatacatacaaaacctgacgcagcggaaagaggaagtcatcagattgatctctgagcaggacaagctgacggacggactgaagcaaaaaatcgagcaagcggtgaagcttcaggaagtcgaggatttataccgccccttcaaacaaaaacggaaaacaaaagccaccgtcgccaaaagcaaaggccttgaaccgcttgcggactatattctttctctcccgaaagaaaaccgccttcacgacgtcgctgatcaatatatcagtgcagaaaaagaagtcgcttcaagagaggaagccattgaaggcgcgaagcacatcatagccgaacaaatctcggatgatcctcatttcagaaagtggatccgccaggaaacgtataaaaaaggaattctcacttccgcggcaggcaagtcagccgcagatgacgagaaaaacgtctatgaaatgtactacgagtacgaagagccgatccaaaaggtcgttcctcacagagtgcttgcgatgaaccgcggtgaaaaagaaggcattttaaagattgcgatcgaaccgcccgccgatcagataaaagcttatttagaaaagcaaatcatcaaacaccgtgaaacacctgtgaaagaaacgctgaaagaagccattgaggacagttacaagcgcctgatccagccggctattgagcgtgacatccgcaaagagctgtcagaaaaagcagacgcccaggcgatccatattttcgctgaaaacctgcgtaagctcctgctgcagccgccgatgaagggaaaagtcgtgctcggcgtcgatccggccttccgtacggggtgcaaactggcagtcgttgatgagacgggaaaagtgctgaaaatcgacgtcatttacccgcacgctcccgtcaaaaagacagcggaagcccgaaaaaaaatcaaagaattgctggaccggtacgaagtcgaggttgtggcgatcggaaacggcacggcatcacgggagacagagcaattcgtcgttgatgtgctgaaagaaacagagcgggacatttattatgtcatcgtcaatgaggccggagcaagcgtgtattccgcatcagaaatcgcccgtgaggaatttccggattttcaggtcgaagagcgcagcgccgtctccatcgcgcggagattgcaggacccgctggccgagcttgtgaaaattgatcctaaatccgtcggtgtcgggcaataccagcatgatgtcagccaaaagcatttaaacgaatctctccgttttgtcgtagagaccgtcgtcaaccaagtcggggtgaatgtcaatacagcatcagccgcgctgcttcaatatgtagccgggttatccaaaaccgttgccggcaatatcgttaaaaaaagggaagagctcggaaaatttacaaaccgcaaagagctgaaagaaatcccgcgtctcggcgcaaaaacatatgaacagtgcatcggctttttgagagtgcccggaggacgggagccgctcgaccgcaccgggatacacccggaaagctataaagagacaaaggcgctgctcaaaaaactgcagctcactgcggatcagatcggaagcgcggacgcaaaagagaaaataagcgcattgccgctttctgaaacggctgaagagctcggtataggggagattacgcttgcggatatttgcgggcagctgacaaggccggagcgagatccccgtgacgaagtgccgaagcctttgctgaaaaaagacgttctgcagcttgaggatttaaaggaaggaatggaattgcagggcaccgtccgcaacgttgtggacttcggcgctttcgtcgatatcggcgtcaagcaggacgggcttgtgcacatctcaaaactgagcaatcaattcgtcaaacatcctctcgacgtcgtatcggtcggagacatcgtcaccgtatgggtcgaaggggtggacgtgcaaaaaggcagagtgtcgctgtctatggtaaaataaaagcactgcttacgagcagtgtttttttctgtagaaataccagcactggttcagcagtttgatttggtaattgtccttttctaaaaacgctttttgcatttgtttcatcagccaattcggcatggctcattcctcctcagcttttagttagaggtcggttttaacacattgtatgcgaacggtgaattgtcccgttcaatgtttttaaagcggggtgcacatatggataacgaacaacttcaaaagctgacggaagacatctctgcacaggatttcggaaagccgttccgtcaccgggcctttttcaatgaccggctgaaaacgacaggcggccgctacatgctgtcttcccataacatcgaattaaaccgcaaatatctgctcgaacacgggcagagcgagctgataggcatcatcaaacacgagctgtgccattatcatcttcatcttgagggaaaagggtacaagcacagagacaaagatttcagagacctgcttcagaaagtcggagcgccaagattctgcacgccgctgcaaaccaaaaagacacaaaagaaaacatatatgtatagatgcgaggcttgcggccaacagtatataaagaagcgggcaatgaacccggaaagatatgcctgcggaaaatgcagaggaaaaatcaaaagaattttttaaaaaggcttgactcatctcaatgatctgtgttaaattataaaagtcgttgagagacaacgatactttctcaaaaaaataaatgttgcttattgacacaatatgtcgcatcatttataatgaagaaagtctgattattccacagtagctcagtggtagagctatcggctgttaaccgatcggtcgcaggttcgaatcctgcctgtggagccattatggagaagtactcaagtggctgaagaggcgcccctgctaagggtgtaggtcgcgtaagcggcgcgagggttcaaatccctccttctccgccagataagttctcaaccagacggcccgttggtcaagcggttaagacaccgccctttcacggcggtaacacgggttcgaatcccgtacgggtcaccatttaccttcgttgggctatagccaagcggtaaggcaacggactttgactccgtcatgcgttggttcgaatccagctagcccagccattttatttaaaatttttgaatcacttttagagcgagccattagctcagttggtagagcatctgacttttaatcagagggtcgaaggttcgagtccttcatggctcaccacttgtcacgcgggtgtggcggaattggcagacgcgctagacttaggatctagtgtcttacgacgtgggggttcgagtcccttcacccgcactttcttttcaaagtgatgatcatcatcactagcttatatgcttagtggaaagacagcttcatagcacgcggtcgtggcggaatggcagacgcgctaggttgagggcctagtgggtgaataacccgtggaggttcaagtcctctcggccgcatctcaatgataccaagggtttaactacctttggtatttttttgtttatagaaatttgtctgttactgcccacttactgcccagttacttatagtaagtcgtctagtttgatgcccttcgttttttttttacttatcttggtgagtggtcaaggtttctttactcccatttactgtccagaaaatatgaaaaaacatcaaaaaaggtgtaaataatgataatgagcgctgtataacccttaaatataggacatgataatatttcataaggctgaggggaaaagagcaagaaaagcaggagcagaaaattggagaaaagtaattactaatcggtttgatttgcatcatataggatttaatacaaaaaccttttatttctagaaaaagagaagatgaacaacctggagtgaatttatctccaaattacagaaaataaggatctatttgtaaaactaaaaaatgatgaaattacggaaaggtaatgagtgattacctttccgtaattcgttaattatttctttgggcaattttatatttcatcttaacactgccaccttgagccgttggtgaagctgtaaatgtgtaattgtatgtccaaccaaaccaaccatttttaacctcggcagaaatgttgccttgcttgcctggtgcgatggttcttgagacttttccatcaattgatatttttatgtcattacttccgttatttgaaatccagaagtttacttgtgctccgtcattctcatctaattcgaactcccgactccagcttgattgatcaacagagccctctgaaacctccttgtctagagctttgaataccccacttttaactgcataatttttcggcgatacacttgtagtcgactccgcaaaagcaggtatagtacaagttccaacaattacaccagctatcagagtcgatgttactcctttgaaaatggatttaagattcacgatcaagcactccttttaatttcatttattacacatacatattccatatgcacaatacaaataataccatgtaaaataattacagtaaacgttcttttggataataatgtttgtaactcaacttttgtaccccaaacatcccaaatcagacaagtaaaccttgatatagctaggtaagtggaaattgcgatcttcttattgaggcactgctactagcaaagattttccgatacccgcaaaacgcaaaaactatcgcacctagtgggcgagactgcattacttctcttgttagtggtttcttaggtcttagctgaaattacaaatttaaaggtaatattttcagtgatttttgaaaacaggtggaaatgaagataaagaatgctttatttataaggtttatgtaatacttgatacgttttcattaggttgagggcccagcgggtgaataacccgtgaaggttcaagtcctctcggccgcatctcaataataccaagggtaatagagagatccttggtatttttttgcgcttatttttaaatgatctactgcccacttacctaaagtaagtcatctgcagtagacatcgcacaaatattttcatcatttatagttagctactaatgcctcaaactccaatttacaaaagtagagaaagtgctgctaagcatgggaagaaaaccaagacttcggggagaatgtttgctgatgttgaaggtttttcgattgaagtcgctgattattttcatgaacgaggaaatttaatgttctctacgaaaattaaaaaaggggagatgattgatgaaaatcagccgggttctattggctgcagtgattttaggtagtgtattttcaatcacttatttgcaaagtgatcaaaatactcaacgtatctggacaatactttgcttggttcttatttgtcgatagtcgcagtaacgaaagcactaaacaacacattaaacagattcttttaatatgacggacacatatgacagtttgcgattgtcgaaattcaatgtataacccttgttcaacttaccaagttcagttaaaagtttgttaaaattgtgataaatgcatgaaaggattaaatgttcatatcgaaacattaggattacagggaaggggaacaaatacatgtcgatttaccataaagtaattggagatggatatccgatcgttatgttgcatggttggacacttgaccatcaggtgatgttacatgcaatggaaccgttattcgagaaacgaagcggttggaagagaatatacatagacttaccaggtatgggacattctaagccacaaccgtctattcagaactctgatgatgttttagaagcgatattgcgtcttttggacgagattattcctgatcaacagtttattgtttgtggtaattcatatggagggtacattgccagaggtatcgttcgttcacgtaaggaaacagttcgtggattactgctgatggcaccattaactatacccgaattcgataaaagggtagtaccgcagaagactgttctaaaaagagacagcgacttgatatcacatttgtcttcagaggaagcgtatgaattttgctctatggggattgtgcaaggtaaaactgaatgggagaggtttcgagatgaaattttacttccatctaaacaaacaaattatgaattcgtaaacaacattcgtcaaaatggatatgggtttaccttcgatatttcatctaaacttgagtatcccacgctaattatcacagggcgtcaggacaatgtagtcggataccacgatgcatggcgattaatagaagattacccaagggcaacttttgcagtgcttgatatggctggtcacaacctgcaaatcgaacaaaccgatgtatttaattcattggttcacaactggttaaacagacttgagtcggaaaatttttgattggtataactttctataagtgtgagttttactgttacaatcccaattaattaaacaataattaagataaggaatattggggtttcctataatgtttagtaattattagtatttactgtcattgagggtaatttaatcattgattaaaaataaaaccattatttcatacccggtgctacttatttctgttgtagtctgcatactgattaataggtaagaaaagtcgaaaaggtatacgaaattcgtcatacaaattaaagttttgaatgaaagagcaggattactcctgctctttttctttctaattgggctagattaaacgcagacggttattccttgggaaaaacaaaaaaatttcttctatccattgactagcttggctttagccgggtttctaccaccctgttgggcttgtcagattttaaaaaggtatgctacgtttatagtgttttgtttcacctgattgtggggtaataaagatagaatcagtaaataattcttaggaacgacctcaatcttataataaacatattggaagacgtaatggaagaactaaaataaaggtttaggatacttttaagaaataaagttttttatcgattgtgatcatattcacaatagagctgtatgaaggggaatcatttctccaaatagtctgcagaaaataccaaccgcagcccgaggatatgtcactaaccgttttggctggtattatctgttggctgtttctctttttgttgcttcttgtattatttttagcccaatcggcaaaaataagttaaggaaaccagcgaaaacactgaatttcatcctttttcctggtttacaatgttatttggcgctgatatggatattagtctagtcttttaaggtacagttgaaccaatcagccactatgccgttagctctccatcaggtgaaacagaaacccccagacttttagagaagcattacgctatacattctgggactgcatgctcggaccgtttatgcgcttgtataatgtggatttgataattaaggagtcgatattattaaatgaagtttaacaagaaaaaaattaacgttgtagacattcaaaaagcgaagaaaagcgtgtttgctacagggataggaaacgcgatggaatggtttgattttgctttatattcttatttggcagttattattagtaaaaactttttcagtccggttcaaaacgatgaattaaagttaatatttacttttgctacatttgcaattgccttcttacttagaccggtaggcggaattatttttggtaaaatgggtgataaatttggtcggaaaatggtattaacaattactattttaatgatggctttatctactttaataattggtgtgcttcctacctatgatcagattggtgtatgggcccctatattattactctttgcccgtattctgcaaggcttttctgtgggtggagagtacgctggggcaatggtatatatcgcagaatcttctccagataataaacgtataaggttaggcagcggtttagaaatcggcacattatctggttatatagtagcttctgttttagttacagtacttttctggactttatctgatgttcaaatgaatagttggggatggagaattcctttcttcttaagtattccaataggattatttggtttatatttgagaagtcatttagatgaatcaccaatctttgaaaatgacatctctgaaaaccaagaacaacaaccaggtttatttgaagtcattaaaacatataaaaaagatatctttttatgtatcgtatttgtggcatttttcaatataaccaattacctattgttagggtatatgccttcttatttagatgagaaccttggtataagtgataatataagtacaccggttacagcaattgtattgattattatggtaccgttcgctttaacttttggtaaactgggagataaattaggaaataaaaaagttatagcaattggattagtattaggaattgtattttcgattatctctttccaatttcttaatatggggaatataactttcttatttataggacttttaatgttaggtattgtattatctgtatacgaaggtactatgccaggatctttacctacgttgttccatacggacattagatatcgtacattatcctggacattcaacttatcagtttctatttttggcggaacaacacctttagttgcttcttggttaacccatgtgacaagaaacaatttggcgccgggtttctatttattggcagtcagtttaattggcttaatagttgtgttaaccttatttaaagatacttcaggtaaatctttaaaaggttcatacccaacagttgcttctaaagctgagtttcaagaagctgttgaaaatccaaaagattcactgtggtggaaaatggaacaaacagaaaaggaatgaaaaaaacatccatttaattgaacgactactcgaaatacagactcagaataagctgggattatccgagcagcaatgactgcagctcttttatattctggagggctcactgctttgcaaaagcagcgttgctattctcgatcgtcattattttattggttgtgtcctaataataaaacattgacgcaagaacgaagagaaattaaaaggtccgggcaatacagcaaaataagaagctttgttatgccagttcttctcccgaaggagagctggctttttattttctatatggggtccaaagcagaaaacgagaacttgtacgctaactaatcaacaaaggttttttggatatgaagagggtgaagtggtgaaaaaatggagtttgttgtggagttagcttttcaattagggggacatctcaacaacaaaataataaccagcccgattaaaaagctcatcaaaagttccattattccaatatacgatccactcaattatttgagtggatctgtttgttttttatttatttgcagcagtctctatgtgacgaaacaataaatggattaaaaccctttacgcagccaggttgcggcgagatcaattgctccgcgcgcagcttcagttttagctaaggcgttgagcatcacgaaatcgtgaatgataccttggaaacgtacggcagtgaccggaacaccagcttcacgaagtttattggcatatgcttctccctcgtcacgaagtacatcagcttcagctgtgataatcaatgcaggtggaagcccttgaagctgctcagcagttgcacgcagaggtgatgctgtaatttcagcacgctcgttcgaattggttgtgtactgatcccaaaaccacatcatcgcgtccttgcgtaaaaagtatcccgcagcaaactgttgataggattccgtatcgaaagaagcgtctgttaccggatagaaaagtaattgttgccggatattcaagtcacctcgtgctttggccattagcgtgacagcagcagccatattgcctccaacactatcacctgcaattgttagactctcgggaatcatgccgttctcacggccattttcagatgcccacttcactactgcatagatttcttcaatggctgtcggatattttgcttctggagataaggtgtaatttggaaagacaatagcagcttgtgctccgactgctagctcacggatgagccgatcatgtgtatgctcattaccaaatacccagccggccccatgaatgtacacgatgacaggaaggtgcgcaggtgcattctgcgggcgcattattcttactgatacctgtccgctcggtcctcctgaaatcataatatcttcaatatcaactggcagtttatcaattgggtcagattgaacctcatctacagcttttcgtcctttctcaggtccaaggtcgaatagatagggtgggttcgcggttgcttctgcaaattcttgagctgctttttctaattgtactttctttaacatcaatctcactccttatttgaaggttgatcacctatatgttttaatcaaatttttttattctattgcctattgatcttggcatctttcgtcttacattgctgttgtaatgatttgtacatcaatatttccgcgagtagctttagaatatggacatacttgatgagctgcatgtgttaattcttccgcttgctcttgagataccccttgaatttccacctccagaacaactccgattttataaccattatcactttcatcttttaataaacttactttaccggtaacagctgattcgatttttaatcgttgtctctgggctgctaaatgaagagcactgtcataacaagctgaatagcctgccgcaaataattgttctggatttgtagcagtggatacttgatttcgttttggcatagctaaatccaaatcaataataagatcattagatgttacatgaccttctcttccgccttttgttgtagcttctgctgtaaaatatactgtcatcatcaaacactcctataaattaaatttaacacaattgaattttaatcaatataacaagcgttgtcaattaaatttttgaaaattaaattgttctcaattgaaattcgcaattaaaatcctctaaatgattgattagactaaaataaagaacagttttcggcagtttaaagttagtgtacataataaccacattgagaaaataggagatcatattattggtgataaattctttctgattttgcataagttatgattaattaaattgttagtcattcaattttacttaatgtaattcttatgctattatgtgtagtaatgaatataaatattgtgagggatttaacatgaagaatgataaattactgttaagtaatcatctatgttttgcgatttatgcagcttcccgtgaaatgataaagttataccatcctctcttaaaagaattaggaattacgtatccacagtatttggttcttcttgttttatgggagaaggaaaaaatatctgttaaaggtttaggcgaagaattatatctggactccggaacattaactccagttttaaaacgacttgaggagcgaggtcttattataagagagcgttcaaaagaggatgaacgaagtgtaattattacgttaacaactgaagggaatgagtttaaagaaaaagtcacaatgatccctaatgcagtatttgataaaaccggttgtaatgaagaagaaattaaaagttataacaaggaaattcgtaatttacttcacatgctgacaactgagcaatagttttgtgaatatagatggtggcccagcgggtgataacctgcggaggttcaagtcctctcggccgatcccaatgacaccaagggttttgacacctttggtattttttgtttatagacttactatagtaggtcgtatgatttgtcagtcaccttcatccttctgctgactgcgtgcggcggtagtaaataggataatgcaattaatgaagtgattaagcaggagaagaaagtcagaaaagaaatgcgagcagattctgatgagtacaaaagagataacgccataatttctgtatatgatgacgggaagtatattcagcttgcgttttatcagccagaagaaagttctcgcaagcttactgcttaaaaagccatttttcaatcaaaaaatcaatatcaattcggggctggattcaatataacccagtccctttttgttttattgattttttatccccagtctgataaaagattttctgtgaatcatttaacaattatcggccgatttttctttttcaataatatcctttaccacatcctcaattgttatatgtccaagagctttttccaaggcagattgggcgatttcaaatattggaccaattgtactttgaatgttccggcctacaggacattgaggattgggattttcatgtatactaaacaattctttatcttgaacaacatttactgctctataaacatcaagtaaggtgatttcagttaaatccttcgctaattcagctcctgcaatacctggccgtacatttactaaacctgcttttttcagcatccccataatttttcttattaaggcgggatttgtatttacacttccagctaaaaattcagaagtgctaattccgtcttcatttatttcaataagagccaatatatgaattcctacagcaaaacggctgctaatagacatgatttcttcaccatcctaattactttacactctttatagtacacttgtaactgaatgtattacaagtttatttcactctaatatgctcaattaacaagatgataaaagtattgacaaataaataaggtgtaactaaaattattacatgtaatcaatttggttacatttaaaattttgaatgattagggggactttaaattgaaaattggaatcattggtgcaaccggaaaagctggaagtcttatcttgaaagaagcggtaagcaggggacatgaagtaactgcaattgtaagagatgctgcaaaacttaaagaggaaaagatctcaatcattgaaaaaaatataattgatctgacatcggatgatctaaaaaagttagatgtagtagttaatgccttcggagctccattaggagaagaacaggcacatgtagatgctggccgggcattaattagggcattaaaaggaatggggacaagagccgtaattgtaggcggagcagggagtctttatgtagacgaaaataaaactgtcagtgtaatggatacaccagatttcccggagatttttattccaacagctaaagggcaaggtcgtaacttgcaagagctaaaggagacttctgatattaactggacatttatcagtccttcagcggtatttgacccagacgggaaaagaactgggttttatcagtcaggaaaagatcatcttcttgtgaattcgaaaggcgaaagttatatcagctatgcagactatgcaattgcagtattggatgaaatagaaaatccaaaacatataaatgaacgctttacagttgtgggagaagctgaataagttattgagtaagaaacaaaggtgccattagcgtcattgctaatggcattttccttttaagaatgtacggagacattgaaaactttgcaatcagagtagctgattatttttatgaaaaaggggatttatcatgttccaatgaatattatcgaactgatgacagagcaggtgcttagtgagttggatcaaaaaaatacgtataaatagctctgactaaaacctttgcgggttagttagagcttttgtaaacccactcgttttcatgagtgggctttttaaaaatacacctctcaacatgatatttattattaagtacggtaaggggtccgtcaaaacttctaaattacaaatgaaggttctcactaaaaaacctgccgcacgtttaacaaataaaacatgaatgaacatattattaatttgcagttatttccgtttcgtgctatgataaaggagaattatttttgttcgtgtaaaggatagtatgaatatcgacttttcgtcttgatgatactttgggcaaggatagtaatacaatgtgtaatacactaggaggcaacaaaaatggaacaaggtacagttaaatggtttaatgcagaaaaaggttttggatttatcgaacgtgaaaatggagacgatgtattcgtacacttttctgcaatccaaagtgacggattcaaatctttagacgaaggtcaaaaagtaacgtttgacgttgagcaaggtgctcgtggagctcaagctgctaacgttcaaaaaactgcttaatcttcaatcgtttatacaaacaggctctttatatagggcctgtttttttatgttctctgtatcatactgaataaaaaaccctactcaacgttcgagtagggacagatgctacaaggtaagaaaaaggtttaaaacctcaaaggattgtttacagtataacataacggattgacgatatgtggaatatatataaatgatttgtttttatgttctcaaggtaactgtatgttattctttgttacaattcgcatatctcttttatgaaaagaagataaacaactgctattcactgtcgcaagagatgtaagaaattcttaaagataaagaggggagtggttgttttttcttccggaaataatcacttagacctaaaacaatgaaagccctgcctctcttccatccttacggctccttgtccgtgccagtgtgaatcaggattacaaaaatcaagtgactatttcatcgagaattcaagtgttcgttgaagaaaaaataaaacagattagattgaggagtaataaaagcggttaatgtttaaaaagtaagttgaagaagttgaacgtctaatcgtaatattctgaaaaattatctatcattaaccttaacagaaactttttatttgtttttcagtgattcctttaatgacttccagttcactaatcaaaaattcatatgcattatccaacatttttttttcgcttgaattaagtgctttttctttcttcattcgcattaaatcacgtacaacttcagcgccttcttgtatttcacccgtttttattttgttcgtgtttactatatacctttgcttccacggcagtaacctatctgattctccatgctgaaaaatgtgtataatgtgttttaatgcacgtatatcagtaactggccgtatatttgaactcgatattttacgcgttggaatcataactgtcatattactgattgacattcttatgacataatactgttgtttttcctctaagaattgtttttcttctatggcttcaatcgtacctgctccgtgcattggataaacaatgttatcgccaatttgaaacatataatccacctccatatatgggaacttaacttaaggttaccatatatgaagtgagatatcaaattttcaataataacatgatcgtttatttgtgtcaataaatttttttaaaaaaacaacatcaaaacaagagggaacctttgggattcctaaaaaaggaaggtcaattggtcggggtatatcttggaatctcgactaattaacagagatcagtttttcgttgaaaatgagttattaaatatcctttaggagttcatgccttgacatcaatgacacgtttactaatctatatgggcacaatttaatcaccgatttttaaccatcattcatgaaaacatagtaatgaaaacaagctttcataaccttagtgtatctgccattcttctgcgtgcggcggaattagatatgataattcgattaatgaaatgataaaataggagaagaaagccagaaaagaaatgagtgcagattcagatgagaaacacaagaataactcatcatgatcgtattcgtacacatttttacagaggaggacaattatgattggaatactggcaggcatggggccaaaatctactgggccatttgtagataaagtcgtagacgagtgccaaaaaatatatggagcaatacatgacatggattttcctcatatgatgatttattcctgtccgacacctttctacatgaataaacctctcaatcatacggacatggaaaatgcaattattaagggtgctgtaaagcttgaaaaaacgggtgttgattttattgccattccatgtaataccgcacatctctattttaatcaaataaaaaaatcgatttcagtccctttactaaacatgattgatgaaaccataaaaaaaatacctaaaggctcaaaaaaagcagctcttttagccaccgttcctacggttcaatccggaatatttcaagaagcgttaaacagagaaggttatgattttttacatcaagatagttggcaaatctatgtcaatcaaataatagaaaagattaaacaaggtcaaatcgatgaggctagtacactatatgatgaattacaccgtgaattagcagaaaaggttgatacggttatcattgcatgtacggatttaaatatggttacggatcaaaaaagaagcgggcttacctttgttgattcatcagcctgtctcgctcaagccattgtaaataagtatgtatcattaacaaaataagtcatctgatttatcagcaaattcagggcgctttttttcctttaaagcgcccggcttcggcagatacatgatcctcaattacttctttgaatgtaacttccccgcgttattgttcttttaaccttgaatactttcgatacgctttatagaaactgcagccaaatagaacagccataagggcgggaagcgacctcaaaagggcaaatggagtttcaaataaaaatgccttccaaaacattgcgccttccatactccacagaccttcagctaaatacaaacctgaatccttgtaaatcaaataagaataaaacaagcacagtaacccaaaacaagatgaaaaactcattagtcttttataataattactctttgactggcgatccgagaagatttcattttgatcatcatcttctttttgccaatatcgagttccaagcccccaagggccatttatataactccagccgaagtcttcatagatctctttgtaatctttaaattttttctttgataaataatcttgataatccagtctcatcacatattttttgtcggttttttcgaaagtgtatattcctaatccgctgatatttgtacagcgatagcctttttgtaattgctcgttcagccattgctcctctttttcaatatcaaaaaacatcttaaatttcttcattcgattcacttccttcgtgcagggataaaatatgcagtaacctgttttgttccatcttcaaaatggcgcttccttccgcagttatcttatagacttttctccggcctgattctccaacaggctcaatccagccatgcttattcaagttttcaatcgcgccgtataatgtgccggccgctaaaataacagttccgttactcatcttttcgatcttctgcatggcggcatagccatgaagcggctcacgcagagctaataaaatataatgcatggtttcagacagcggtaataatttatgtttcatatcctcatcctctattcagttcgactatatagttaaacttaatacagtacaactgaatagtcaatggtcttttcaaaatttgtaaaaggaacttgaaaatcaaatctaaaaagtcgctttctttacgtaatgggaagtgactttttgtatgtccatattaacgtcaaaagaatgtatcccggtacgtaactgttttccgatgtaacagtgtcgtttattttcaatgtgtttttttacggtaagaaaatcatcaaattgaaaggggatgaaaattaatagttgactcaagcaactgtttcgattacgatggaaaaagtttcttaagtcaatcttttggaggaggttcaacaatttggaaacaaaacgtgttttggcattcagacaatttaatagattttatacagacattttgggttttctgaatgaacatatttatgacagtccattctctttaacggaaaccaggattttatacgaaatttataatacgcccgattgtacagcaaaaatcattcaagaaaggttagacctggacagaggatatgtaagcagaattatcagaaaatttgaagaagaaggcttcatatacaagcaaaaatgcagagaagacggacgcaaccatttcctttatgtcaccgagtcagggaaaagtatttataaaagcctggagaaaaaagctaatcagcaagttgaatatatccttgaacgcatagacaaagaggaacaagaaaaacttgtacattcaatggaaatcattcaaaacattttgcagcattctttttatgataaagaatctccgatttcaataagagactattatacttcagaggatgtcaaaaacataattgagaaacagcgattattttatgccgaatcccatcgctgggatgaaacatttttatcctatcttcacgatacgtttaaagcggatattgaaaaaatatgggtggcagaaagcgggaatcaatttgcgggttgtatcggcttagtgaatgacgatgaaaaaacaggtcagttaaggtggttcttagtcgatccgtcatttcaaagaaaaggtgtcggcagccgtctgattaaggcacttgttcaatattgtaaagaaaatggatacgagcgtatatttctttggacggtaagagacatgtcaacagcccggccattgtataaaaagaatggattcgaaattacagaaattcatgaagaaaaacctttatggggatcaaatttaatagaagagcgctgggatttggaattataaagtgaggggggataggatgcgaataaaatatcactatgcatggatcattgtgtttgtcactttttttacctttttagcagttcaaggcgcgcgtctttcatttggagcttttgttgaaccatgggaaaaagatttttctatgaatagaggaacaatctcacttatttccactctgagttttatcatatatggcatatctcagcccataatagggaggctggttgataaattaggtccccgaatgattttgtcagtcagcactttcgtagtcgggatcagctttatattgacttcttttgtaaatcatccatggcaattatttatcctttacggaattgttatctccgtcggtgtcggaggggcatccaatgtagccgcaacagttgttgttacaaattggtttaatgaaaaacgcggacttgcttttggaattatggaggcagggtttggcgtgggtcagatgcttcttgttcccggctctctcattttgattcaatggtttaactggaagttaactgtagtgattttgggtctgcttttaatggttattgtgtttcctgtcatactgttatttttacggaatcatcccggcgagatggggttatctcctatgggcggttttatgaaagcaggagttgaaagtgaacagcatacggcccgcttttctgtttgggctgtgttttgcaagaaacaattctggtttttaatattaccttttgctatatgcggttttacaactacagggctgatggatactcaccttatccctttttctcatgaccatggattttcaacaagtgtaaccagtgccgcagttagtgtattggcgggatttaatatattggggataatcatttcaggaattgcggcagaccgttggagcagtaaaaagatgcttattcttttatatgccatacgcgcattatcaatttgtatcctgttatatagtcatcatccggtcatattacttatttttgccaccctgtttggactagttgattttgcaactgtagcccctactcaaatgttagccacgcaatattttaaacaatattcagttggttttattttaggctggttattcctgagccatcagataggatcagcgctgggagcttatgtaccgggttttctctatagtgaaatgggtaactatgatctttctttttatttctcaattattattttgttgggagcggcaatatttactttcttactgcctgaaacggttaaaataaaaaaagagcaaaaaccgaccgattcagcttcaaatgaaacagtatcccagcgtgtgaataacccgtgaaggtccaaatcctctcagccgcataaaaaataccaagggtttgagtcccttggtattttttgttcattgtatgatgatgtaaacttcttgcttatttagcgctgtcattccagtttttctctataaatgtattcgcaggctgtaagttggttttgttcgcaatttcaatgacagcgggaaccacggaagggtctgttttggagaagttaggaatccgcggatctaaccggaaaaagcgatctcccagcagattcgcgctgaccatggattcatagtagccatttccgccggagatcatctgaagaaatggcagtaaaggttcattaggcgacctgtccaaaaggactccccaatttggaggaaggttcttcagattttcgggacgtatgttatccgcacttaccattccccatcccctcgtatctcttcttaaccgagtcggggcttcacctgtcccgatggatagcgccgcaatttgatccaatggcacgttggctttaccaaccgcaaacgcgatactggccgtactggggttcgttgccactacatatccgtccacgtagttttgataggcgcgctgtgtcgcgggagcaccgctgctccgcagtatgacatcactcactttctcatttaaatagggagagccgggaaagttgtgaaataatacgggcgtccaacgatccagtgccggggagtataatttgaatgaagggacaacaattcgttttcttacatctttaagacgaaggcctggcgggaaaaagtttcgtaccgctttaataaaaccggaatatggtaattgctgattgaaaacaggtccgcccggccgggaagtgctgaatgcgggcaggatttcatcctcaaaatactgaagtgtttccttcggagatcttccgcttgctaatgccagggcagtaaatgaaccgattgaatttcccgcaaatacatgggttcggcttattaatgccggattttcttcagccagtctgttcaatagttgtaaacttaaagcacctaatgtaccgcccccgtcaaaggtcatgatccgatattttgccaaagctgatttctcctttctgatgcaaactatcattcagtatatgttcagccagagtctattgtatggatgaatgaatatcttcttatcttaaaaatggtttgattatcaatccagcgagtcgggaaaggatatgttttttatttgaagaggttttttccgtgaagaaggagaattattatttaaaaataaaagggggaaaatacttgaatacaattgaccttattgttttacattttgaagaggtaagacggcgaagcatcaagttatggacagctgtacctgaggaaaaaatggactggcgcccggattccgaagcaatgtcgtgcaaggaaatgataagacatgtattagaagcggaatttctttatcatcacattttactaaaacaaatgaatgagtcttcagaggaatccgaaaacccgtatgaatcaaaaacgtttaccacagtaaccgaagaattagaattcgccaaaccgtatcgggccgcgtttttgacattcatcaaatcgttaagcgaaacagatttaacaaatataaagattgacaggtctgatgttggatatattcgcgaactgggagacatgttattaagaatcgcttaccatgagtctgtacataccggtcagcttttagactacctcagaactgctgaggttgacaggcctttaatttgggactagtaaaatgattgagttttacacgggaaggggaaagaatggaatataaaccgattaatttccaagagaaattagctgcgttccaagatcaatggtctccaaaagtaatcgctgaaatgaatgattatcaatttaaacttgttaaagtacaaggggattttgtttggcataagcatgacgaaacagatgaagtctttattgttattaagggtaatttaatcattgaatttcgtgatggagaagtaaaattaaatgaaggtgaaatgtttgtcattccgaaaaatgttgaacataaaccttatgcagaatcagagtgtaacattttgcttgtagaacctaaaggtgttgtgaataccgggcaggaaataactgatcaaacagctgaaaatgatgtctgggtctagcctgtaacaaaaaacgatcaaaactccgaaagaccgaatgacattagagacaatgatcaggaaaaccaattaagaataatttaaggttaaatatttaaaaatttgttaatattataatacattgtttggaaatgtaatctttttttaaggagttttctaattgcgttggagtaaatggttcaatattttttgcatagcagcattgggatcaatatatggctataaattgtttactaatcaagaagtcagtacggctcgtgtaatcatagctgctgctattatcttgtggaacattgtcggactttttagcaaagaaccagtaaaacaaacacagcaagcaaactaaaaaccaaaaaacactttccaatcgttcaataaaaagggtgctgcagcgtgcagcatcctttttatcattttcacaaaaaaaccaagggtttaaccccttggttttttcgtagtctccctttttaagctgtttatgataatcgtcaaaatcattcaagtttcatcaagcatccagaatctgttgcaatgataaatgaaaattgccctaaaaatgtgccggttcatcaaaataccagtccaagctgcagttctttctttacatagtatgtagagattaaaaaatgagagaaggagtggcgtaatgtattataacgaaggtgaagatcaacagtacgttccgaagaaaaagccatacaatgaagcctgtgaccttggtcatgattttgatatggcggacgacgcagcaagagcggaagcggcaagagaagcagaagcgagagccagagcggaagaagccatagcaagggcggaagaagcaagagccagagctgcagaagcagcaaaagcagcagcagaagcaaaggtagaagcggcaaaattagcagccaaagcgaaatgtaaaaaacgtcataagaaagagaaaaaacatgattgcaaacgtaagcacaagaagaaaaaataagagcttttcatcatgtaaaagataagattcaatgtgtattgattttatccgtacaggggtgcaaaaacgataaagaaaaagattcttgtcgggggatcaaacagaaagattgctcagccggtgtctcagcagaaccacccatggcagggcaaacataatgttctatggacttccatagtcaggtcgggatatcacgccaataaatgtaagtgcctatcatggtaggaaagacaagagtttcggcaggttgccgctcttgtctttttttgtttttatatcatcttcgcgtatatgtatctatttttaagtttgcagaacatctgtctaagaatttgtccaattcctgcatatactggtatcggaatcaaatgcttattgggagtgaaatagatgggatcagcacagttaacgggacgtgtcatcttcaaaggggaccccggctatacacaggcggttaagaattggaacccttatgttgatgtctgtccgcttgtctttgtttttgcacaaaattcatacgatgtaagtaatgctattaaatgggctcgtgagaagaatgtgcctttacgtgtcagaagcggccgccatgctctggataaaaatctttccacggtaagtgatgggattgttattgatgtgagtgacatgaataacgttttcttagatgaaaaaaacgcggtagcaaccgttcaaaccggcattcacgtcggcccgcttgtaaaaggtttagctcgggaaggttttatggccccgttcggagacagtccaaccgtcggaatcggaggaatcacgatgggaggcggatttggagtgctttcacgatcgatcggcctgataagtgataaccttctcgcactgaaaatggtagatgccaaaggcaggatcattcaagcaaatcattcccgcaatgaagatttactgtgggcttccagaggcggcgggggaggcaatttcggatataacacccaatatacattcaaagttcaccgtgcccctaaaaccgcaaccgtctttaatatcatttggccgtgggaacagttagaaacggtatttaaagcgtggcaaaaatgggcgccgtttacagacgaacgattaggatgctaccttgagatttacagcaaagtaaatggtttgtgccatgcggaaggattgttcctcggttcaaaaccggagctggttcaattattaaaacctttattaaatgccggaacgccggcacaaacagtaatcaaaacactatactatccggattgtatagatttcttagatcctgacgaaccgattcccggcagatctgatcagagtgttaaattctcctcggcgtgggcgctcaatctttggccagaagaacctattgcagtaatgagacaatttttagaaaaagcgactgggacagaaaccaacttcttttttatcaattggggcggcgcgataagcagagttccaagcagtgaaacagccttctattggcgccgtccattattttatacggaatggacggccagttgggaaaataaatcacaagaagcttcgaatcttgcatcagttgaaagagtgcgtcagctgatgaaaccatatgtaacaggttcatatgtgaatgttccggatcaaaatatcgagaacttcggaaaagcatattatggctcaaactttgcaaggcttcaaagaataaaggcgaaatacgatcccgaaaatgtattccgttttccgcaaagcatcccgccatcgtataaataggttgatcgttgtgggaaacaaattaaaaaacacaccagaacattcaggtgtgtttttattgttgctgtaaaatttggttattcacttgcatcccagtgcggattccaaacgatttcccataagtgtccatcggggtcttggaagtgaacggcgtatccgccacaaaaagtatcatgagcgggatcagttatcgtaacgtttgattcatgtgcgatgtttttgcggtcccaaagggcaagtttcagtcctgtttgcaagtcgttcaaatctgtaccggctgttccttctgtaggcagacccaagccatcccgatagaagtgcagcgatttttctaaattgtctgcgcctaaagtaattactgtaatccgcggcttcatagcaatgcaacctcccaagctaagctaatgataagaaacattttcattgaaaatattttgacatttcagtaaagaacctatatattcgtatatgagcacataatcatataaggttatttttgtgtccgtgttagaatgcttcatagcagaaaagaaataataaatacagtgtattagataaggaggagatttttatgggtcacaatcacaatcacgctggcggatccaataagaaggttttattgatctcttttatcatgattacaggttatatgataatagaagcgataggcggatttttaaccaatagtttagcgcttttgtcagatgcaggccatatgctgagtgattcaatctctttaatggttgctctgattgcttttaaattggccgaaaaaaaggcaagtcatcataagacattcggctacaaacgatttgagattcttgcagctgtgatcaacggtgttgcattaatattgatttccctttatatcatttatgaagcaatcaaacgtttctctcatccgccggaggtagcaacaaccggcatgctgacgattagtatcatcgggttagctgtgaatatattggtcgcttggattatgctgaacggcggagatacaaagaataacctgaacattagaggagcttacttacatgtgataagtgacatgctcggatctgtaggtgccatactggctgcgatccttatcatcttcttcggatggagctgggcagatccagtggccagtgtcattgtggctattcttgtgctgagaagcggttaccatgtgacgaaagactccattcacgtattaatggaaggaactccggaaaatatcaatgtcactgacatcattcatacaattgaagagacagaaggaattcaaagcattcatgatttgcacatatggtctatcacaagcggattgaatgctctttcctgccacgctgttgttaacgatcagctgaccatttctgaaagtgaaagtattttacgcaaaattgaacatgaacttggagataaaggcattacacatgtaaccattcaaatggaaacagctgcgcataatcacgacaatacgattctttgtcaggcccaaactgagaatccgcgtgaccatcatcatcattaaaggaggagatagggactcactttgtctgctgacaattaagataaaaccggaggggggttcatatgtacgacacgatagtaatcggagccggtcaggcaggaatctcagtaggatattatctaaggaagtcgaaacaaaagtttatcattttggataaaagtcatgaagtgggggaaagctggaaaaaccggtatgactcattggttttatttacttctcgaatgtacagctctttgccgggaatgcagcttgaaggagacaagcatggactcccttcaaaaaatgaaattgctgcttatctgaaaaaatatgttaaaagatttgagatcccgatccaattacggacagaagtaataagtgtccaaaaattaaacaactatttcttaataaaaacaaaccgggaagaatatcaaacgaagaatctggtggtggccgcaggcccttttcatacccctaacattccatcaatatcaaaagatgtagccggtcatattcgtcaattacattcttcacaatataaacattcaaaacaactggcgcctgggaatgtactggtagtcggcggcgggaatagcggggctcagatagctgttgaattatccaaagaaagagttacatatttggcttgcagtaataaaccggtttattttcctttatggattggaaaaagaagcattttttggtggtttgataaattaggagttttacatgcaagtcatacatcaatattaggcaagttcattcaaaagaaaggcgaccccatatttgggtatgaattaaaacatgcaataagacagaagaagatcatcttaaaacaaagagtcatagccggaaagcaaaatgaaatcatttttaaagactcatcttcattagaagtaaacaatgttatttgggcaactggttttaagaatccgctttgttggatgaaaatagaaggtgttttggataaggaaggccgaattatacatcaccggggtgtttcagctgcggagggattgtactttattggtttgccttggcagcataggcgaggttcagcgctgcttcaaggtgtaggaaatgatgctgaatacattgtgaaacaaatgaacggtggatagactgaggagagcagtaacttacgggtttactgctcttttttgtgttgaataagcccagttatgtgactgtggctgttttaatcggcttgtggaacagaaaacacaatatctcttggttgtcggactggtgagtgcataccccgggcaagtttaagtttctcggctgcaacagtgttaccaaaagttacaggcctttggtattttttatgcaaacgggttttgtggccaaaacgattctgctaacttcagtcttttaggctgaacaagggaattccttagtatggcacactctcattacaaaacgcataggataatatcacaaaaatttaaaattgcggggatgaaaaatgtattatatacctttttcgcatcaatgttattattgtgtgaatgtgccgatgtatagcgatggaagatctgtttattggactattccaaataactatgatccttcatacgaagatagaaaccttctcttgaaagattatggaccaaaaccatttgtcgtgaatatcaataaagccgcaaaacaaaacaatacgttccgtacggccctatggacaggaaagcattttcaaattactttgatgagtcttggcattggagaagatatcggtttggagatccatcctaacgtagatcaattcttacggattgagcaaggccgagggctagttaaaatgggcaagagtaaagatcatttaagtttccaaagaaatgtctatgatgattatgccattgttgtccctgccggcacgtggcacaatgtgattaatacgggtaatacgccgttaaaactatattcaatttacgctcctcccaaccatccgtttggtacagttcatgtgacaaaggccgatgcagcggctgcggaagattagtataggattccagaggactttgctgcggcaaagactataaaaaaaatcgtattgggacagcatgatcaaatatagcgatcgaatggctgaaacacaaaatattaacgtttcagcttgtcatagtgcagttgatgcgatgctttattccacaactactcaacagcaaatgtggttttttgtctgaccattttaattgattggcagtcagtgaaaatgaatttgtaataaatttatccttgctcctcctaaaagcggctttaacagccaagtttctgtttctcttcaaaccatttgcgaagctgattaatatgagcttgatgatatctattatggtctgccatatgccatattccccattgaatggttgcttgtttatctgcttcataatctactgtgtgattcagttgatcgtcagttaactgataacaaacagacttaaacatgctgaatacttcttcataatcagtgagaatttgttttaatgaaacaccggaaatgaaagggatcttattgttctgatctaacattggtccatacttctcttcaagctgctttggtatcggttcaccctttattctaaatatccagttgagatcaacatatgctaagtgtcttattagctgagctgtactattgtatgtttgatttggtcctttataatcgatctcctgctgtgacatgtctgacacaatggatattaagcgacggtaattttcattaacggcagaatacagcattcccacaagatgatccatgtgcgtttcaccttttaaatctaaaatcataaaaccccgcctcattagtacaatttttatatttagtttgccttattactcttatttgtcaagcaatccagagaatgaatcgctataggatgaagcaatgaagcaggctctctttgcctgccttttttgtgtgtcagcctttacatctgacatgttgagttatctgaaactgtcctttttaaatgtcagacagtgttatatgatactctgcagatattcaagaatagtacttggaggtcactctcatgcaaattttattgctatccctacgccttttcatgaagatgaacgtttatattcagcaggatttgatcctaatgtcgaacatttgaaaaacagcggtatccattcggtactcatatgcggcacgactggtgaacagcattcactcagcatggatgagcgccttcagatcattgagtatgttaatcagcgaaaatttgaagatgttgaactgaagttcggggtttcagccgtaagaaccagtgatgccgtcaaactgatgaaacacatcgagaaaaccaatattgattctgtacggattgtttttcctccttatataagaccgacacagcagcaagccgtttattacattattcattcatcaattgacttcatattatttcatttgataacataaaatggttattgtgattgaaaaaggatacccgtttttataaaaaggagtcataacgttgctgaaaaggttttttcttgtttttcttacgctgatgatgtctatatttgctgtattcgcggcggctgaagagtctcccggcgatcgtgtcatttcttttgacgagcctatgattttattgatctcactcggaatcattttatgtttgttcattccgccattcgtcatgtccttttttagcagcttggttgtgagaatcatatccggcgtctatcaatgttttatcgttctcacgtttgcgggcctcattccgattggatttctgattccccatggctttttgacaattcttgctgccgttctggggactttggtcagttcagcgagtgtggccgtgaccttattcgttggcaggaaaaaagaggccggaaggttttaaaactagtgggtaagctgcaatattgaaggggaatcccagtgatatccgcagcgctttttgccggtcattgtttgactatttatatggaatagcatagaattaaagtaaatatttataaaaagtcactaggggagctttaatagctgagaagagacaatacgtcctgaccctttgaacctgatttggttaataccagcgtagggaagtgaaaaattagagagattctttatcttatctatatttaagccactttccatagaggaaagtggctttatttattttgaaagggtgatatgaagtggcgacgaaaaaagtttttctggcagggccttttaaaagtttagtagatgagaaaactggattgatgagtacgtatgagagaggaaagctggaatcattaatttccttttttgagaatgaaggatggctggttcataatgctcacaagcgggaagggtgggggaaagatttcatgacaccccttcaatgcactaaaattgattttgatgaaataagcacttgcgacctttttgcagcattccccggatcacccgcttctcccggaacacatatagaaattggatgggcttctgccttgaaaaaaaagatcgtgctatttctagaaaaggacaaggattatgctttcttaattcaagggttaaatgcagtggcggatgttgagtacatcagctataaagatacagatgatttattagagaacattaaaaatatctttgcagcatataaggcggaatcttaatgagaaagagaacttttcatgaagcatatacggaaacgctgtatgacatctatcacaaccctgaatttttcaattcaccgcgcggacaaaaaagcagagaacaattgaactaccatctgactctggaaaatccaatagaacgtgtcacttatttatcctcaagaaaaaccaatatcgtgtttaattttgcggaagtgttatggtatttatcggggagtaacgacttagattttatcagttattacaataaaaaaatgccttcatattcaatgaataaaaaaacattaacaggcactgcgtatgggcctaaaatatttgaattcggaaatgcaaaactaaatcaatggaatagaataaaaaatcttttgacacaagaagatattgattcaaaaagggcatttattcaaatattcgatgcttcggaactcttcgtttcagaaaatatagatgtttcctgcacaatcggtttgcagttttttgtgagggaaggcgaattatacatgtcttctatcatgcgtgcaaatgatgcttttcgcgggatgatcagtgatcttttctcatttaccttcatgcaggaattaatggccagagaactgcgtttagaagtcggagaatattttcataatgcgggatcaatccatatttatgattcagatcatgaatgggcgaaaacggtgcttgaagaagctgaaaatcaccatgatattccggaatttgaatttccgaaaatgcctgagggaaataactggccgtccattgaaacagtcttaaagtatgaagaattacttaggaaagatcaaatttctatgactaaaaacgatattgaaatgctcgatttacctgattactggaaacagattcttttccttttcagtatataccagcatattgcatataaacgggatatgggtcattctctatttcaaagtttacttcctatatatcaatttttcgtcaggaataagtggtctcattatttctcaattgagcaaaaggaggaaattcaatgaaaacttcatggaaagaagacagtgttgctggtaaattcgatgcttataatgacgttttagaacaaacgttaggttttgagtttgtttttcgtacttttgataaagcggagattaaaaaggtgctggatttcggatgcggtccgggaaaggtagcttataggctggctgacagaataggctgcaatgtgatcgcagtcgatgaatcaaggaagatgttagatatagcaaaggcaaaaagacaacatcctcatgtggactatcatttaattgaacacgataatctttccttcttaccagatcactcggttgatgctgcaatggcctgttatgtttttattaatacggatagtgaccagcgtatcaaaggtatcataaatgaaatttttcgtgtgttaaaaccaggagcttcatttgtcatactcgatacgaatcctgattcaaccggaattgaattttcaaccttccgcaatggaataccggggaaagaatattcttacggagaagaaagaaatgaatggctccatgttccgggacaagcagatttaattttaaatgattttcattggccgaagtcaatgtattataaactattaactcatgcaggttttgaaaatgtaactttatcagaaccaacgttaaacgatattgaccaagagcatgtaaaagccatagagaaagagtttcaatttaataattggaaatgtgaaaaggaatatccgccttttgtcatttttaaagcagtgaaacctgcctgaaggaggagtgtaagttgaaggatatttataaagcgctttcgattgctgggactgatccttccggaggggcgggaattcatgcggatttaaaaacatttcaggaacaaaaggtatatggaatggctgttattacatcagttgttgcacaaaacacacttggtgtgaaaagttttgaggagatgtctctacagaatatatctcagcaaatagactgtgtcatggatgatataaaaccggatgctgtcaaaaccggtatgcttgcaagtataggaattattgaattgctggcagaaaagttaaaagacgcaaatattcaatcgtatgtgatggatccggttatgattgctaaaagcggacatcatctgctccataaggacgccattgatcatttgaagaaattattaataccccaaacaacagttattacaccgaacattccggaagcggaagtaatcatcggcaaatcaatcgagactgtacagcagatgcgtgatgcggcgaaagaaatagtggaggtatacggggcaaaaagtgctgtcgtaaaaggggggcacctgaacggagaagcccgtgatattttgtactttgacgaggatttcgaggaatttgtttctccccgctttgatacaaagcatactcatggaacaggatgtacattttcagctgtgataactgcagagctggcaaagcagcacagcataccggaatcagtggcaactggaaaggaattcatttcagcagccattaaacatcccttaggaatcgggaaaggacaaggccctacaaatcattttgcgtatcgctcaactattaaccaagagacaccgcttaaggagtgttacgatgatctccaagaattatgatgtatttttatttgatttagacggagtgatatatataggagataaagctttaccaggagctgtggcctctttaaaacgactccgtgaagaaaagaaagccattcgctttttaacgaatgatccttgtgttacaagagaaacgattgtgaaacgccttcataaactggggatttcagcaagtattggtgaagtgtttactgcggggtgggcaacagctgattaccttgtcagtgaaggaataaagaaggcatatatattgggaaatgaccaacttaaaagtgaaattcaaaaggccggtattgatcttacggaagatcaggcggaggctgttgtcattggatgggatcaaaatattacatttcaggatgtgcataaggcagtaaacctcatccgctgcggagctttatttatcgctgcaaacggggataaaacatttcctgccgctaacggaccagctcccgcgacaggcgctatagtcgcggctgttaaaacagcagctgctaaagagccgatgataattggaaaaccggcgtcttcaatatttgaaaaagtactcgagtcttttgaagataaagagagatgcgttatgatcggggatacgcctgaaacagatattgtcggagcaaaccaaataggcataacttccgtattagtttctgatcaacatactttatttcctgcaaaacatgattttagaaatccggatgttgtgatccgcgatctgaaagacttgttcgataatgaaataaaggcagaagtacggaaaaaaccggatttccaatggacagaacaagtgaaagccggagtcgctggaattataattaaagaatcaagttccgttttattaatgaagcgtgctgataatggtttatggggcattccttcaggccatgtggaacctggtgaaacagtagaacaagcaattataagagaaatagaagaggaaactggattagtggtgaaagtctctaaaatgataggcgtttattctgatccgagttcacaaacctttatataccctgacggcagagtcagccattttattaccaattgttttcaatgtgacgtcatcggcggcactttgaaaaagtccacagaggaagccatggaaatcagatattttgatatccatgaattacctgaacatctcttgccgatgcacccgagatggctggatgatgctttggaaatgaaagagaatgcttttattcgataaggaacagtacgccaaaaatactttttgggggttatttaaaagaattaacggttctcaacccgtaactctcggccgccttccaaaaacaccaagtgtcacagacccttggtgttttttaattccggcaggaccttaatgcaagagcggcagaaaagaaggtataatgggcggagaagaggtgtcagccaatgaaaataaccagagagacattagaaaaacagcaaatttggatatatggtgtgactcttgtgatcggcggaatagcggggatcgccgggaaagattcaggacttcgctggggatggacgatatcaccgcttatcgctgttctcatgtatgccatgtttgctcaaatcccattcttgaagctgagggaagccatgtcaaatctcaagtttatggcggctttactgatcggtaatttcttagctgtacctgtcgttgtatgggcgttaaccgctatttttcctcaatctcctcctatattatcaggggtttgtttggtattgcttacaccttgtattgattacgtcatcgtctttactcagctcggcaaaggaaatgagagattaatactggcttccacgccggttttgttcgccgttcagatggtattgcttccgttatacctgtggctgtttatcgggaaagaagtaatagggactgttcatgcgggaccgtttctggaagcattcttattgttaatagcggtgccgctgctggcggcggtgatgactcaactatgggctgataagaagccggcgggagaaaaggtgttggaatggacggcgtggctgcctgttccttttatggctctggtcttattggcggtcgtcgccacacaaatcggcaaagtcatcagtgatgctgacatcattatacgtgtgattccgatctatctgttattcctgctcattatgccgtttgtctcccgttttatcgcatatgcgttccgtctggatacaggtgaaggaagagcattgatcttcagcacgggcacaagaaattctctcgcagtccttccgttagcactggccttgccggatgcttgggcctcattagccgccgctgttatcgtcactcagacgattgttgaattgataggtgaattggtttatatcaaagcggtgcccggatggctgctgaaataaaaaataatctgcgctgaaaaaaacataccaatagatattggtatgttttttatgagaattataaagttgcaatatcaatgacgaaacggtagcggacatcgcttcggagaacccgttcgtacgcttcgtcaacttgatcggccggaatcacttcaattttaggagcaatgccgtgctcagcggcgaaatcaagcatctcctgagtctgcggaataccgccgacgagtgaacccgcaatgctgcggcggcccgtgattaaggagaacacactgtatgagtccggcttagcgggcgctcccacatttaccaatgtaccgtcaatgcgaagcagggataagtaggcatctacgtcaaggttcgcggatactgtatttaaaataagatcaaatcgtccggccagctcagtgaatgtattcggatcgcttgtcgcaaagtaatgatcagctccaaattcaagcgcttcgtcttttttgttcattgagcggctgaggacggtgacctctgcgcctaaagcgtgcgcgaattgaacggctaaatgtccgagcccgcccattccgacaatcgccacttttttgccgggaccggcattccagtgtttcagcggagaataggtggtaatgcccgcgcacaatagcgggctggctgcatctaattccaattgatccggaatacggacaacgaatctgtcagtgacaactattttctggctgtagccgccatacgtaggatttccgtcgtagtccaggttattataggtctgaacaacgccttttgtgcaatattgttcgtctccgttcaggcagtattcacattctccgcaggagtctacaaaacagccgacacccacacggtcgccggcggcaaatgtggtgacttcttcacctacggcttccacaactccggcaatttcatggccgggaaccatcggaaagattccgccgccccattcatcgaatgcgctgtggatgtctgagtgacaaatcccgctgtacttaatatcaatcaggatatcgtgcggccgtaatgctcttctctcaatcgtcgtccgctcaaatttagcttttgcatgcggagcgcttaatacacgagtcggatgattattgcacatggttatcttcctttccaagataaagtgatgaatcctctgttcggttttactttaaatgttaaagcggactttaagtcaaggggtttggtttatttttctatgaaatgatattctataatggcacgcttatgaaaggtatgaaggatgggtggtaagaatatgaagattgcgcaggctgcaaagcaggttgagttatcagccgcgacgcttaggtattatgaaagtataggactgattcctccggtaaaacgcgatgaaagcggcatccgcgattatgacgaagatgatgtgaattggattcaatttataaaatgcatgagaagtgccggactgtcgattgaggcgctgattgaatataccgctttatttattgaaggagccgatcatacgatcgaaccccgaaaaaacatccttataaatgaaaggaaaaggctgacggagaaacagagggaaattgatgaaaccataaaacgattaaacaggaagattgaggattacgaagatatcctggaaaatgaagcgaaacttaaaaacagattgaaagctgaatgtatttctgaatgaagagaaggtgtcccgggcgccgggccgcatgaaatgtaccaagggaaacgagccttggtttttttattttctaaagagaggaaacaaaacagctttttctatcttatcaaacattacttatccttttttcagcttgacttttttactgcagacttttaaagtgtgaaatgttgcttagactgtgattagcgactttaatgctgaaaagaggtggtttacccagatgaacaatcataagaatccttgggcgttattgcctttagtcttattcgtagggctttttgtcggctctggtctggtgaccggagatttttataaattgccgatcttgattgccgcgatcattgcgtcagcttttgcgctgttatttaaccggaagaaatcgctcaatcaaaaaatagaatggttcgcttccggtgcgggacatcctgatattatcattatggttatgatttttatattggcaggtgcctttgcttcagcggctgaggcgatgggagcggtgcattcaactgtcaatcttgctttgagcgttattccgcagcagtttttgctgccggggctgtttatcattgcttgttttatttctatatcgatgggaacatcaatgggcacgattgcggcggttgcgccgatcagcgcgggtctgagcggagagcttggcatctccggcgcgattacgatggcagctgtggtcggcggagctatgttcggagataatctttcttttatttccgatacgaccattgcgtcagtccggacgcaaaaaacacaaatgatggataaattcaaaacgaacttcctgattgttttgcccgctgctattttaacggttattatcttattttttattccggcaggccacgcgggccatgcgggcgctgcatcttacagctggattaaggtgcttccttatgtcgccgtgttggtttttgcgttaatcggttttaatgtgatggctgtcatattcggcggattggttttgacggggatcatcggattggcgggcggcagcctgacgtttgactcttattttaaggcgattacggatggaatcgccggaatgagcgatctgatcatcctgtccatgctgatcggcgggatggtcggcgtgatgaaacaaaacggcgggatcgactttttactggagttcatcacgaaacgaatccgttccaaaaaaggcgccgaagccggcattgccggactggtcagcgtgacgaatctggctgcggccaataatacgatctcgattatcgcagccgggccgattgcaaagaatatcgctgataaattcagcatcgacaacagaaaatcggcaagtattctggatatcttttcgtgtatgatacaaggattgattccttacggcgcgcagctgttatcagccgggaaattcgggaatatttcacccgtcagcatcctgccatactctttctatcccgttttaatcggaatctgcggcatcgccgccattatatttggactgccgaaattcacaagaaatacgaaataaaagataaaaaaaggcgccgttcggcgccttttttctttcatgacagccaagcatttctcaaaagctgtacgccctgtgcgatctgatccgtatcgagatgggcgaaacctaactttatgatcggcggttcaggctttccggcaacgaaataaacggcggtaggatatactttcactccgtactgaaaagcgcgttcgattaatgtttcttctgtatagttcaggtgaactctcaccaatatatacaatcccgactgctcgccgatgatcgtcacctgatcgccgaactgctgcttgatatgtgaagtcaagtgctgcatcttacgcttgtagacagtgcgcatgcgcttaatatggcgggtccattcaccggccttcatcaattcagccatggtcagctggttaagcgaagaagcggtgctttcgaaatgaataaaccgttttttataccggtgcaaaaggcgctgcggcaaaaccatatagcttatgcggatgcccggtagaaaggattttgagaaattccctaaataaatcacccggtctgattgaatggaagcaagagcgggaaacggctgctgtgtataacggaattcactgtcataatcatcttcaagaatataaccctctctatgattcacccaattgatcagtgtttggcgctgctgaatggacatgcttacgccgtaagggctgtgatgggatggggtcacatagattaatttttctttcattgcatgcaattgagaaaaatcagctccgttttcatagacaggcatcgtttccagagatagcccgtgaaattgaaatgccgctctggccccgtcaaacccagggtcttcaacgataattccggaaaaatcctctttcagaatccggctgagatatatcagcatctgctgggtgctgctgccgatgataaccgaatccgcatctgttttcactccgcgtgattccaagagataagcggcaatttgttcacgcaggtctctctcgccgaacggttcaccgtaaaggaagcttttctctgatgccaaaacttgattgtataattttctccatgttttcagaggaaaatgcttttgatcgacggctccggcgcgaaaatcaatcagggccggctgagttgattcggttttcttagcgtaaacaacatcgttttctttttgaaataaagaaggttctacttcatttgcaaaataacctttgcgtgtttccccgcgaatgtatccctccgctaaaagaagatcataagccatcagcgttgtattgcggcttacccgcagggaatccgccagctcccgaatcgaaggcagccgctcatctgcctgaatatttccctgctcaatcaatgttttaaattgctcgtaaatttgtttgtatttcggggtgccgcttctgaaagcgaaaatcatatttttcatcagatattctcctctgacatgtgtatttgtttgaaactgtatctttttaaatgtcagttgatatcttattatagcggaaagcgctttatcaatccatgttcagagaggagagttttgtatgtatattccggctccatttcagctgagtgaagctgaagcgtgcgatgtaatcaaagagtatggtttcgcagcattgttttcaacggcgggaggcatgccgtatgcaacccacctgccattgatgatgagtaaggataacgaatgcttatacggtcattttgcattgccgaatccccaatggaaagagattgatggccaaaacgtgttagctgtttttcaagggcctcattgttatatctcgcctaaatggtatgagacgaatcaggctgttcccacatggaattacgtggcggttcatgtttacggagaggcggagcttttggatgaggaagaaaccgtgcagtcgatgagtgatctcgtcttgaaatacgaaagccccgacagcccgtacaaattagaggatgtcgatgcgaaattgctggcaggcatgaacaaaggggtaaaaggttttaaaatcaaaatcagcaaaatagaggggcaagcgaagcttagtcaaaatcattcagccgcaagacaagggctggtcgtacaacagctcaaacagattcctcatacaaacgaacagctcatttccggcttgatggaagaaaacatcaaacggatcaccgcggacaactgacaagcatgttaaaaacataccggcagcatgcggtatgtttttttctgattatgaagcttttctcaggatgaataacgactcgaacagcacataaatcaacggcgccattaaaatgaagaaagaatgaaaaatagcatacggtatgagtaagtaaacgataagtttcaatagaatggaagacgttttattcaatgtccagcggtttttcaagatatcagtcatacaagctaaaacaaggccgaccgtcaaatatatggctgctatgtaaagataaataaaaaggtaaaacgggtaagaagacaacggaggtgtgtcttcctgtgtcatttttaaacccacataaaagaccaataaaaagcaaacggacgaaacgagagctaacaaaaggtgtttatataaatacttcttcatgtgttcacctgcctatggcgcaattatttcttaacatattatgacatggttttaccgctgctgaaagaattggaagtccggctatatgagcggggcgtaaagaatcaatatcatcttttcatgaatccggatgttttgttcggatggatgtaaagaagaatacaccaaaaaaaaagctgtcagcttggtcctgacggcttattttttgggaaaggcttatttctccgtggtgaaataaagcaatgctatgacaggaaaagcgattccaatccataatgtgatactccacccgcctgaggcgtatgcccatcctccgattgatgagcctgcagcgccgcccagaaagaagattgccataaataatccgtttaatcggctgcgaaattcaggtgccaacgaaaaaatggcacgctgactgagtacgagattggcagatacccccatatccaacaggatagctgcggccaccagaactgctattccgacgggggagctgctctgaatcatgagcgggagtaataaagaaacgatgacaacaccgagagcgattccggtggcaagccgggtcaagccgcgatcagccagacggccgcctatcggtgcagccgctgcacccgcaatgcccgctaatgcatacagcgcgattgccttttgagaaaaatgaaaagcaggaccggacaataataaaggtacagtcgtccagaataagctgaaagctccaaatacaaacgcatgataaatggcacggcggcgtaagaccggagtcgtgcgcagcagcttccacattgaaccgagtaagacggtgtagcttgtgtttgctgttggttttctggcaggaagcacttttgataagacgattgccaggacaacacttaacgcggcggataaagcaaatatggcattccacccccatatatcagcgaccagactggatatcggacgggaaagcataataccgagaagcaggccgctcatcacattgccgacaacccggcctcgtgcggcatctggtgcaaggtatgatgcgaacggaactagcacttgggctgcgatggatcccagtccgatgaaaaacgcagcggctaaaaacagtgttccatgcttcacacatgctgtcagagttagagcggctgcgcttagtaggagcgataccacgacaagttttctgttttcgataatatctcccaaagggacgagaaacagtaggccggcaacgtatccgatttgagtcagcgtgacaatcaatccggcactgcttggagaaagcccgattgccgcactaatgaatcctgccaagggctgtgcataataaagattagcgacaatgataccgcatgccgttgcgagaagaagggttaaactggttgagattctctgatctgctttttgtttgtttaacgtagccatgtgaatgaactcctttttaatgattttatgaggtttgataaatattttgctgattcatctcctctccatagatttttagtgctaaggtttgcggagtgttgagcatttactaaactgtacgtttagtttttataagtaaataatatactgaacgttcagttttgtaaataggcttctgttttatttttttatcatgttaagtatactgaacgtatcgtttataattcgggaaggaatgattcatgtgcagagtaaacgaggacggccgcgtgatgaaggaacacataaggcgattctttctgctgcctatgacctattgttggaaaatggctttgacgcggtgacagtcgataaaattgcagagcgtgccaaagtgagtaaggcaacgatttataaatggtggtcaaacaaggctgccgttatcatggacagctttctttcgaccgctacggacagactgcctgtgcccgatacaggatcaacagtgcaagatatattgatccacgccgcgaatttagcaaagtttttgacaagccgggaaggaaccgttattaaggaattaatcggtgcgggacagctggatgcaaaattggcggaagaatatcgcacgcgatttttccagccccgccgcctccaagcgaaaggccttctggaaaagggaattcagaaaggtgaattaagagagaatcttgatattgaagtaagcatcgatctcatttacggaccgattttctatcgcctgttgatcacaggtgatgaggtgaatgattcctatgtgcatgatcttgtgatgagtgcgtttaagggagttcaagctacgtgaataatcgctcgaatggggcagataatgaaaaggcagaacaaattgttctgccttctcttgcgaacgcccggcagctgccacgcacgcattcaccgctgcaagccccaataacagcccgaagaaaggctggagaagctgcagagctgtttcgttgaagcttgagccagaggtgctgtctcagcagcaaaacatttataggacgggcaggcggagcgccgtatcaatattttgtaaattaaaccggacttgttcatctgtgttccacggatgataccagcctttttccatcatatagcgtgagatttgctcgtgcatgtcgatggcttcttctaagtgacgggtgaggatcgctttcacttcaggcgttccggcttccgtcgccgccatcgcatagtttctgactccgctttttgccgaattcaataaatccatagcgacaatttggtctgtcagtgcatccatccccgtcaagtattccataatcggattcattcgttattcatctcctattcgtgctttgcatcagataaaatcgaggcaaattcctgcaattgccttgttgatgtatccgcatcctgctgcatgatttctttcagctgcggatcggatacgagcgctttcatggttttggatttcgtcagacaaagtgacttaaaagaagccatctcctgaatttcgagtaattcatgtaaggcgctggccatttctgtagcctccgttctctaaggtttgagtacaactttaatacaatcatctgttttcgtgtcaaacatctcatagccgtgcttcgcttcactgagcggaatgacatggcttacaacatcgctcggatcaattttgccggttgacaccagttcaaacatatacggcatataatggataaccggagcttgtcctgatcggatattgacgttccgctgcatgatatcgccaaggggaaacccgttgtatctgccgccgtacacacccgtaatctgaatcgttccgccttttcgcaccgcttgggacgcgatgaccaatgcgctcatggccccgccttgaagttttaatccgctggcgaggaactccagatctgtcatttttccgtccatgccgacggcgtcaatgacaacgtcggcgccgcctttggtgatttccttcaggtagctgcccgtattttcgtggtcttcgaagttcacgatttccactttattcgtccgtttcgcatgctggagacggtagttgacatagtctacggctatgacgcgtttcgctccctttaaccagcagaatttttgagcgaaaaggcccacgggcccgcagccgagaacgatgaccgtatcgcctgcttttacgccggcattgtcaacgctccaaaaaccggttgtcatcgcatcggcaataacactcaatttctcatccggttcttcgcatgtttcggggactttaaaatgggtgaagttcgcaaaagggacgcgtaaatattcggcctggccgcccggatagccgccggtactccctgaatagccgaaataagcgcccatatcgccgttttcatttgattgatcacattggctttccaggtgatttttacaataagtgcattctccgcaggcgatattaaaaggaataatgacgcggtcgccttttttgactttcgtcacgccgggaccggtttcttccacaatgcccatcggttcatgcccgataatatagtcttcctgcaagttcggaatgagtccgtggattaaatgtaaatctgatccgcaaattgccgtacttgtgacttttataatcatgtcatcgtgtttttcaatcttcggatcaggcacgtctttgactacgacgtttttcactccttgatacgttacggccttcatgctgtaatacctccagtgttagtgttcatcaggtgtgcggtcaaacatcccttttctgttcgtttcaacgggaaacagattcatgtttccgaccatgagggtatttttcgcagagagctggtccagtttatactgttcgctcagatcatgcgggtgaaaccactttttgctgaccatcaagtcggtaatttcctgatgcatcgcgattccctgcatgagctgtttgcgcagcaaagctcttacatcaggtgaagcggtttctgttaaagcgacggcggtatttctgacgccttcttttgcccgtaaaagaaaatccattgcgaatgtcatatctgcgagttcagggacgtgtaatgaattgattggatctaaatagtcatgattcaatgatgcttaccttcctttcaattaatgatcgaagtcggccggttttgaggaacaggagcctgaaaagatgcccgttcataaaccgcctgcagatcagcaaggttttgcgaggcttgctgaacgtctttttccattaacgttttcagatcctgatcaaacacaagcccttgcatgagcttggatttcgctacacaaagcgtcttgaagttaatgatttcatgtaagtccagcgactcgtgagccgctaattcacgcttttccataatcgttttttaaacctcctcttctcaattacataattaatttcccctgagaaaagagctctagtcttacaaattttgtttataaaaaaagagagaagaaatctgacggtacattaaaaaagaggaagcacaatcgcttcctcttgttcacatggaatggctgtcggtgtcctgaacgtttttctgatgcgcgggcggttttgccgcgcgggagacgagaccgctgaaacccgggaaaggtcataaaaaagatatgaacaaaagcagcccgcgaacaatcccgcaggctgttttttctttcacccgtcatgcaggacagaaggggaaggtgagaagcaggcgattatggtatgatgacaaatagaataaaacatcgtgaggccggtcggctaaaaggaagtggacagagattgtttggtacaaaacatcaagaagactatgtctcccgtgacagacgctcattgcatatgcttgcgcttcgggtgcccggtctggcgtttatttttatggtatatgccgcatcagtctctttgcagtacatttatgaaagctggacggttttattgctgctgttattcacgatattgatcgtcatttttgccgtgctgcactggcattcctatcgctgggtcaagaaaaaaacgtttctttatttcatcatacagggattaatcatatatacatcggctaacttgatgaccggcggctatatcgcggcggtcatcggtctctatgcctttttaatcgggcagattatcggaatggcggataagggcaaaacgctgctcatactctatcttttcattttaatgtccatagcagccctgcaccaggagcatccgcatcatctgcttcgtttcatcgttatcgccgctcccatcatgatcgtgattatcacgtatgcggcaacatttttcgcgcaagttgatgaaaaaatcaaaacacagatgacgcttgaaaaattagagctcgctcaccggcaagtgaaacagctgacgcttcaaaacgaaaggcagcggatggcgagagacttgcacgatacacttgcacaagggctggtcagcttgcatatgcagcttgaagcggtgcatgttcatctttcaaagggtaacactgacagagcgaaagacatcatcagccagtcaatggatagagtgaagggcacattggctgatgcgcgctcggccattgacaaccttcgcagcaaatcagaagagatcgggttcttaaaagaaagcatcactgaacaaatcaaccattttacagaagcctccgggctgtcttgttttttagattacagcgtgcatcatgtgcttgacgttcatacggcggagaattgcctttacatgattggcgaaggcctgactaacgccgccaagcatgcagaagccaagaatgtctgggtgtccgttcaggaagaagagggacagatccgcataaccgtcaaagatgacgggaaaggctttgatgccggaacagaaatgagaaaaagcggacattacgggctgcttgggatacaagaacgcgtcaatatgatgaatggcactttccgtataacaagcgccagagcagcgggaactcaaattgagatcatcataccaattcaaggagaagcggaacatgtataaagtgttaatagcagatgaccatcttgtcgtcagagaaggtctgaagcttttgatagaaacaaatgaccattacaccataacgggagaggcggaaaacgggaaaaccgccgtccgccttgcagaggaactaaagcccgatgtcattctcatggatctgtacatgccggaaatgagcgggctggaagccattaaacagataaaagagcattctgatgtgccgatcattattttgacgacctataatgaagatcatctgatgatagaaggcatcgaatcaggcgcgaacggttatctgctgaaggacacaagctcagaaaccttatttcatacgatggatgcggcggtgaggggagaagtgcttctgcagccggacatcttgcgccgtttccgggaaatgaaaatggaacgggcaaatgccaatgaaacacagctgacggacaaggaaatcatagttctgcaagccgtggcgaaaggacataaaagcaaagcgatcgccttcgatttaggaatctctgagcggacggtaaaagcgagattaacatcgatttataacaaattaggcgctgattcgcggacggaagccgtcaccattgccatgcaaaaaggcattctgaaactgaatatataatgaaaaactgcccaaacgtacatgcccctatgtacgttttttttatgtgaatgtgaactacaattaggcagaaagtaatgattggagaggagtattcgatgtctggttttttatataaattagggggatggtctgcccgcaaccgattcaaaatgatcagtgcgtggctcgtgatactgatcgcttcgattgtgatcgccatctcgttaaaacctgctttttctgaggatatgtcaattcccgacacaccttctgaaaaggcgatggatgtgattcaaaaagaattttcaaaggggcccgataaaggaagcatacgggttattttcggagctgaagacgggaagaaattgacgtcaaaaccggaaaaacaagcgattgaagagacattaaagaagatcaaaacagatcattcagtcgcttcgattgcaagtccttttgaaacaggaaccatttctaaagacggatcagtggcatatgccgatattacgtacaaaaaagcggcggatgacattacggatgcgtctgtttcacatattaaacacagtctgtccgccgccggagacaagggcctgcagacggagctcagcggcgatgtgccgggggccggtgttgaagccggcggtgtatctgaaattgtcggcgttgtgctggctttcgtcgttctggccattacatttggttcattagtcatagcggggctgccgattgtcacggccctgatcgggttaggtgtaagcgtcgcgctgacgttaattgggacacagatctttacgatagcctccgtcagtctctcattatcaggaatgatcggcctggccgtcgggattgattatgcgctgtttatctttacgaagcatcgtcagtttttggcgaaggtgtacaaaaaaatgaatcgatcgctaaagctgcgggaacggctggcagcgccgtcgtttttgcgggactgaccgtgatcgtcgcgctttgcggattgaccgttgtcggcattccgttcatgtctgcgatgggattgactgcggcactcagtgtgctgatggctgtattggcatcagtaacgctggtgcctgcggtgttgtcaattgcaggaaaacggatgattccgaaatcaaacaagaagaaagaaaagaaaagcgccgacacgaatgcctggggacgcttcgttacaaagaagcctattctgttaagcattttcagcattattcttttagccgtcatcagtctgccggccatgcatttagagctggggctgcctgatgcgggaatgaaagcgaaagacagcccggaccgccgcgcctatgatctgttgtctaaaggattcggcgagggctttaacggcaagctgacaattgttgccgatgcaaaaggggtcaagggaaacaaaagtgaagcatttcaagacgccgtgaaagaaataaaggacttgcacaatgtggcgagcgtcacacctgccatgccgaatcaaaaaggggattatgccatcattacggcagtgcctgaaaccgggccgaatgataaggcaacgaaagaagagttagtgcaggatatacggaaacgatcagacaaaaacggcacccgcctgctcgtcaccgggtcaacagcggtgaatattgatatttcagaccggttaaacgatgcgattccggaattcgccattcttattgtcgggtttgcgtttgtattgctgaccgttgttttccgctcgcttctcgtgccgcttgccgccgtcgtcggctttttgctgacgatgaccgctacactcgggttatcggtattcgttctgcaggatgggaatttcaccggcttgctcagcattccggaaaaaggtccgattctcgccttcctgcctattttagccatcggtattcttttcgggctggcgatggactatcaagtattccttgtcagcagaatgagagaagaatatgtcaaaacaaaaaatccggtacaagccatccatgccggattgaaacatagcggacctgtcgtaacagcggcgggactgatcatgattttcgtctttgcgggattcatcttcgcgggggactctacgatcaaatccatggggttggcaatgaccttcggtgttcttttcgatgcgttcattgtaagaatgaccatcattccgagtgtcatgaagctgatggacatgcggcctggtacttgccgaagtggctggataaaatcattccgaacgtggatatcgaaggccataagctgacacaaggcaaaacaccggagaaaccggaagaataaaatgaaaaagcagatcgttatgatctgctttttttatgtgctgaccgcattcatgaacagagaaaaaagctttttcatgtcttcatgtttttttgtcagcatttcgggatgccattgcacgccgacgacaaataattcacccgttcgttcaatcgcttcaatggccccgtctttcgcataagccgcggctttaaatgaaggcgccgtctcttttatgatctggtgatggaatgaattcacccgcgctgaatcgccaaacaaggaatggagacgtgtccctttttcaaaagaaacatgatgggtttttaacggcggatctttttcttgatcgtgcttaatgtcagcaaacgaagcgtgtgtcaggtcttgatataaagttcccccgtaagtgacgtttaacatatgcatccccggcagattgccagaatcggcttttctaaagcaaccgccgtgagaatcagctccttctcgtaggcatcccgatcaggaaaggtctttcttaaagcctgtaaaggttcttcgccgtaaaacagcgggtctatatcctggccgccggacagaatgatgccgtcaacatgagagacctgttcctttaaaagcgccatctcttgaatcaccggcaatataaatggcacaccgccggcctcagaaacagactgaatataatcattattgacatatgcccgattataaccgggaaagggccggattgatcagccataatgtttcccgtaattccgatgcgtttggccatcctgcgttcacctgaacctttctttctgaaccttctcgtataaatctgaacgtaggttgtacaaatcagtttgaaattattcttcatgatatgtgaacttttcaaaaaaacccgtgacaatcacgggtttttacattcatttcaacttcttgatttcttccgtcagctctttgaacttttgatcaagctcacgatattgtttatcagccggagtcatgaagctgagttttccgaggacttcctgccgttcggtttcaagctttaatcgcagttcttcagcatcatccctgacggagggagattctttccattgttttcggacgctgccgtttgagatatcaagccggatgtccgtcgtcttttcgacaaagtaacgatcatgcgatacgatgatgagcgttccgtcgtatcgggccaaagtgtcttcaagctgctcgcgtgacggcagatcaaggtggtttgtcggctcatccagaatcagcacatctttctcctccagaataaacgccatcagcttgcatttgacccgctctcccatgctcatcttgccgatgggttccgtccattgcgctgcggtaaatcctaaatgcttcatgagggattgaacatttccccttgcttcgaacgtttctttgtaaaaaagctgttcgggggttttacaagcggaaggtcgaatacttcctgggttaa

SEQ ID NO: 5 - DNA, 1442 bp, Bacillus subtilis
ggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttag
